(12) United States Patent
Tian et al.

(10) Patent No.: US 9,441,255 B2
(45) Date of Patent: Sep. 13, 2016

(54) TRANSCRIPTION FACTORS FOR CELLULOSIC ENZYME PRODUCTION

(75) Inventors: Chaoguang Tian, Tianjin (CN); Teresa Shock, San Francisco, CA (US); N. Louise Glass, Berkeley, CA (US); Samuel Coradetti, Berkeley, CA (US); James Craig, Berkeley, CA (US)

(73) Assignee: THE REGENTS OF THE UNIVERSITY OF CALIFORNIA, Oakland, CA (US)

( * ) Notice: Subject to any disclaimer, the term of this patent is extended or adjusted under 35 U.S.C. 154(b) by 0 days.

(21) Appl. No.: 14/233,735

(22) PCT Filed: Jul. 23, 2012

(86) PCT No.: PCT/US2012/047898
§ 371 (c)(1),
(2), (4) Date: Apr. 3, 2014

(87) PCT Pub. No.: WO2013/022594
PCT Pub. Date: Feb. 14, 2013

(65) Prior Publication Data
US 2014/0220641 A1    Aug. 7, 2014

Related U.S. Application Data

(60) Provisional application No. 61/510,466, filed on Jul. 21, 2011.

(51) Int. Cl.
*C12P 19/14* (2006.01)
*C07K 14/37* (2006.01)
(Continued)

(52) U.S. Cl.
CPC ............ *C12P 19/14* (2013.01); *C07K 14/37* (2013.01); *C12N 15/80* (2013.01); *C12P 19/02* (2013.01)

(58) Field of Classification Search
None
See application file for complete search history.

(56) References Cited

U.S. PATENT DOCUMENTS 4,959,317 A    9/1990 Sauer
4,987,071 A    1/1991 Cech et al.
(Continued)

FOREIGN PATENT DOCUMENTS

WO    2010/060188 A1    6/2010

OTHER PUBLICATIONS

Guo et al., Protein tolerance to random amino acid change, 2004, Proc. Natl. Acad. Sci. USA 101: 9205-9210.*

(Continued)

*Primary Examiner* — Alexander Kim
(74) *Attorney, Agent, or Firm* — Morrison & Foerster LLP

(57) ABSTRACT

Provided herein are methods and compositions for increasing the production of one or more cellulases from a fungal host cell. The disclosure is based, on the surprising discovery that mis-expression of the transcriptional regulator clr-2 in a filamentous fungal cell was able to induce expression of cellulase genes under non-inducing or starvation conditions, resulting in increased secretion of cellulases from the cell. Advantageously, mis-expression of the transcription factor clr-2 in a filamentous fungal cell cultured in the absence of cellulose or cellobiose results in increased secretion of cellulases. The disclosure relates inter alia to a method of degrading cellulose-containing material, to a method of increasing the production of one or more cellulases from a fungal cell and to a method of reducing the viscosity of a pretreated biomass material, by contacting pretreated biomass material with a fungal host cell containing at least one recombinant nucleic acid encoding clr-2 or a related transcription factor.

15 Claims, 75 Drawing Sheets

(51) Int. Cl.
*C12N 15/80* (2006.01)
*C12P 19/02* (2006.01)

(56) References Cited

U.S. PATENT DOCUMENTS

| | | | |
|---|---|---|---|
| 5,543,508 | A | 8/1996 | Haseloff et al. |
| 5,792,633 | A | 8/1998 | Schiestl et al. |
| 6,207,384 | B1 | 3/2001 | Mekalanos et al. |
| 6,489,127 | B1 | 12/2002 | Duyk et al. |
| 6,506,559 | B1 | 1/2003 | Fire et al. |
| 6,511,824 | B1 | 1/2003 | Buchman et al. |
| 6,573,099 | B2 | 6/2003 | Graham |
| 6,924,146 | B1 | 8/2005 | Wattler et al. |
| 7,501,275 | B2 | 3/2009 | Laplaza et al. |
| 2001/0010913 | A1 | 8/2001 | Hillman et al. |
| 2003/0221211 | A1 | 11/2003 | Rottmann et al. |
| 2004/0029283 | A1 | 2/2004 | Fillatti |
| 2012/0142051 | A1* | 6/2012 | Ogawa et al. ............... 435/69.1 |

OTHER PUBLICATIONS

Lazar et al., Transforming Growth Factor α: Mutation of Aspartic Acid 47 and Leucine 48 Results in Different Biological Activity, 1988, Mol. Cell. Biol. 8:1247-1252.*

Hill et al., Functional Analysis of conserved Histidines in ADP-Glucose Pyrophosphorylase from *Escherichia coli*, 1998, Biochem. Biophys. Res. Comm. 244:573-577.*

Wacey et al., Disentangling the perturbational effects of amino acid substitutions in the DNA-binding domain of p53., Hum Genet, 1999, vol. 104, pp. 15-22.*

Branden and Tooze, Introduction to Protein Structure (1999), 2nd edition, Garland Science Publisher, pp. 3-12.*

Anisimova et al., "Approximate Likelihood-Ratio Test for Branches: A Fast, Accurate, and Powerful Alternative", Syst. Biol., vol. 55, No. 4, 2006, pp. 539-552.

Bendtsen et al., "Improved Prediction of Signal Peptides—SignalP 3.0", Journal of Molecular Biology, vol. 340, No. 1, 2004, pp. 783-795.

Campbell et al., "Metabolic Control of Transcription: Paradigms and Lessons from *Saccharomyces cerevisiae*", Biochem. J., vol. 414, 2008, pp. 177-187.

Cantarel et al., "The Carbohydrate-Active EnZymes database (CAZy): an expert resource for glycogenomics", Nucleic Acids Res, vol. 37, Database Issue, 2009, pp. D233-D238.

Galazka et al., "Cellodextrin Transport in Yeast for Improved Biofuel Production", Science, vol. 330, Oct. 1, 2010, pp. 84-86.

Kasuga et al., "Long-Oligomer Microarray Profiling in Neurospora Crassa Reveals the Transcriptional Program Underlying Biochemical and Physiological Events of Conidial Germination", Nucleic Acids Research, vol. 33, No. 20, 2005, pp. 6469-6485.

Langmead et al., "Ultrafast and Memory-Efficient Alignment of Short DNA Sequences to the Human Genome", Genome Biology, vol. 10, 2009, pp. R25.1-R25.10.

Roberts et al., "Improving RNA-Seq Expression Estimates by Correcting for Fragment Bias", Genome Biology, vol. 12, 2011, pp. R22.1-R22.14.

Ruepp et al., "The FunCat, a Functional Annotation Scheme for Systematic Classification of Proteins from Whole Genomes", Nucleic Acids Research, vol. 32, No. 18, 2004, pp. 5539-5545.

Tian et al., "Exploring the bZIP Transcription Factor Regulatory Network in Neurospora crassa", Microbiology, vol. 157, 2011, pp. 747-759.

Znameroski et al., "Induction of Lignocellulose-Degrading Enzymes in Neurospora Crassa by Cellodextrins", PNAS, vol. 109, No. 16, Apr. 17, 2012, pp. 6012-6017.

International Search Report and Written Opinion received for PCT Patent Application No. PCT/US2012/047898, mailed on Sep. 27, 2012, 14 pages.

International Preliminary Report on Patentability received for PCT Patent Application No. PCT/US2012/047898, mailed on Jan. 30, 2014, 10 pages.

Colot et al., "A High-Throughput Gene knockout Procedure for Neurospora Reveals Functions for Multiple Transcription Factors", Proceedings of the National Academy of Science, vol. 103, No. 27, Jul. 5, 2006, pp. 10352-10357.

Coradetti et al., "Conserved and Essential Transcription Factors for Cellulase Gene Expression in Ascomycete Fungi" and "Supporting Information 10.1073/ pnas.1200785109", Proceedings of the National Academy of Science, vol. 109, No. 19, May 8, 2012, pp. 7397-7402 and pp. 1-10.

Stricker et al., "Regulation of Transcription of Cellulases- and Hemicellulases-Encoding Genes in Aspergillus Niger and Hypocrea Jecorina (Trichoderma Reesei)", Applied Microbiology Biotechnology, vol. 78, 2008, pp. 211-220.

Tian et al., "Systems Analysis of Plant Cell Wall Degradation by the Model Filamentous Fungus *Neurospora crassa*", Proceedings of the National Academy of Science, vol. 106, No. 52, Dec. 29, 2009, pp. 22157-22162.

* cited by examiner

MODEL FOR CELLULASE REGULATION BY cdr-1/cdr-2

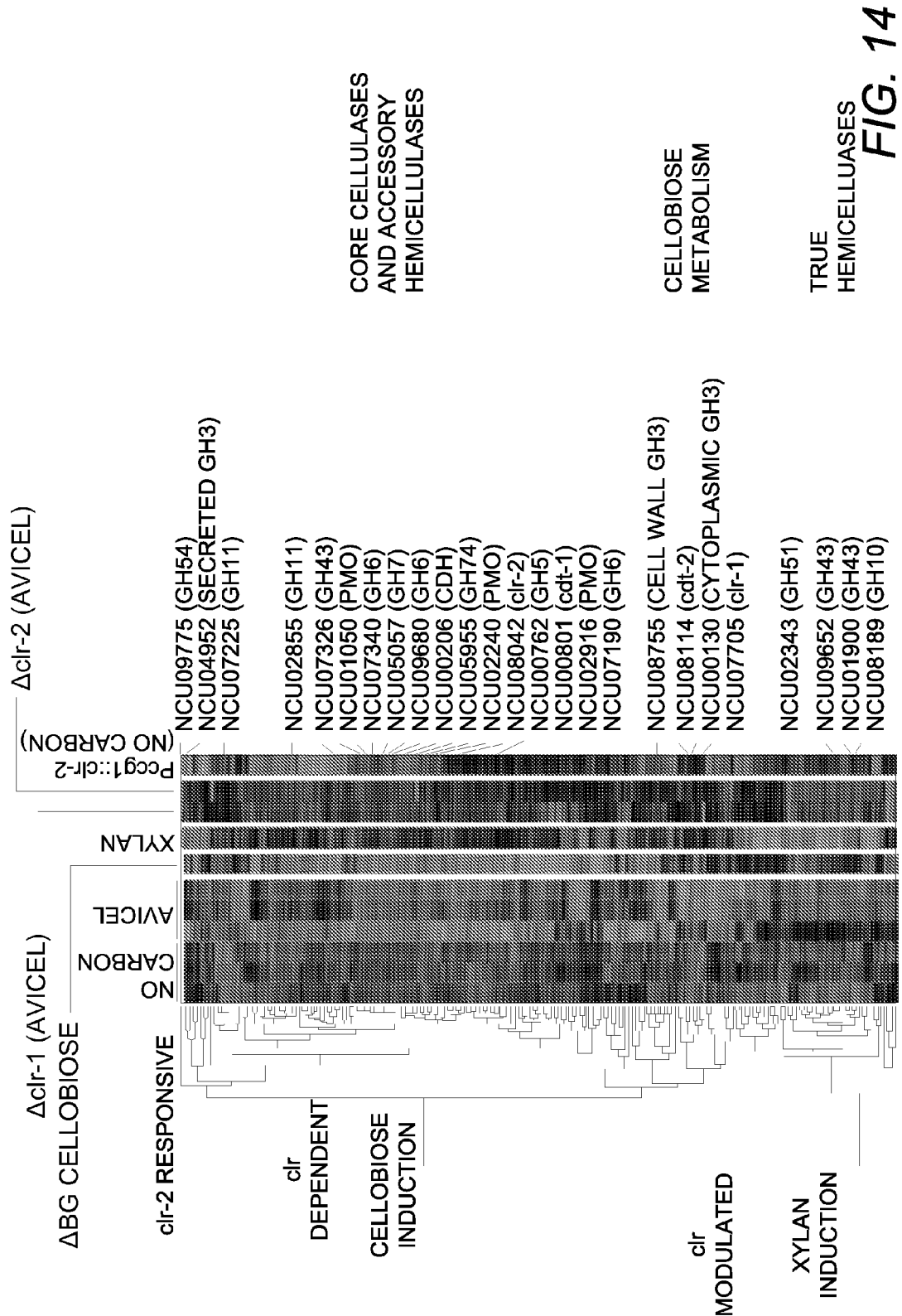

DRY WEIGHT OF THE CULTURES GROWN ON
CELLOBIOSE FOR 48 HRS

DRY WEIGHT OF THE CULTURES GROWN ON
CELLOBIOSE FOR 48 HRS

```
                                                    10        20        30        40
                                                    |         |         |         |
[GIBBERELLA_ZEAE_PH-1]/1-696                        --------MSPSSTGESAHSISINSA----------RPFTV--PARDSFALD
[NECTRIA_HAEMATOCOCCA_MPVI_77-13-4]/1-699           --------MSPSSTGESPHSASMTAAA---------RPFAV--PSRDSFSLE
NCU07705/1-677                                      --------MSPSSNSDSPASVVGSMTMAAQAAPNVV-RQYPL--PNRD-FTIE
[NEUROSPORA_TETRASPERMA_FGSC_2508]/1-677            --------MSPSSNSDSPASVVGSMTMAAQAAPNAV-RQYPL--PNRD-FTIE
[SORDARIA_MACROSPORA_K-HELL]/1-710                  --------MSPSSNGDSPASVVGSMTMAAQAVPNAV-RQYPL--PNRD-FTIE
[CHAETOMIUM_QLOBOSUM_CBS_148.51]/1-704              --------MSPSSNGDSPHSVTATMTTAASA--TVVRQQYPL--PNRD-FTVD
[PODOSPORA_ANSERINA_S_MAT+]/1-706                   --------MSPSSNGDSPHSSTATMTAAASA--TVV-GRFPL--PNRD-FTIE
[VERTICILLIUM_ALBO-ATRUM_VAMS.102]/1-517             ------------------------------------------M--ASRDSFHIE
[GLOMERELLA_QRAMINICOLA_M1.001]/1-692               --------MSPSSTGDSPCSATGNAG----------RPFHV--PSRETFNIE
[METARHIZIUM_ANISOPLIAE_ARSEF_23]/1-682              -----------------------------------------------------
[BOTRYOTINIA_FUCKELIANA_B05.10]/1-535               ---------MSISSQGNSPNSTSGSI----------RHFSM---SRDKFDID
[SCLEROTINIA_SCLEROTIORUM_1980]/1-688               -----------------------DSPNSTIGSG---RHFSM---SRDKFDIN
[GROSMANNIA_CLAVIQERA_KW1407]/1-696                 MPYVGAMSVSSQ-DSPNSTIGSG-----------------------------
AN5808/1-632                                        ----------MPTSNSPTVATAVTAATA--------RHSSAMDASDGGLSVD
[ASPERGILLUS_FUMIGATUS_AF293]/1-633                 -----------------------------------------------------
[ASPERGILLUS_ORYZAE_RIB40]/1-638                    -----------------------------------------------------
[PENICILLIUM_CHRYSOGENUM_WISCONSIN_54-1255]/1-671   -----------------------------------------------------
[ASPERQILLUS_NIQER]/1-651                           -----------------------------------------------------
[PYRENOPHORA_TERES_F._TERES_0-1]/1-712              ---MAGITPSPDVSPVSSATTNGG---------------FPRDAFSLN
[LEPTOSPHAERIA_MACULANS_IN3]/1-710                  ---MAGITPSPDVSPVSSAATTNGQ--------------FPRDSFCLN
[TALAROMYCES_STIPITATUS_ATCC_10500]/1-603           -----------------------------------------------------
NCU00808/1-551                                      -----------------------------------------------------
TRICHODERMA_REESEI_CLR-1_PROTEIN/1-758              ----MPQPHGPAPGLAAAPATGQRQEPLPFLATALAYTGASGPGPSVSVS

CONSERVATION

QUALITY

CONSENSUS                                           ---MAGMSPSSNGDSP+VYTGSMTMAAQAAPNVV-RQFPL--PSRDSFTIE
```

FIG. 21

```
                                                    60              70              80              90             100
                                                    |               |               |               |               |
[GIBBERELLA_ZEAE_PH-1]/1-696                        LPMSSLATMS-----------ADASLKSPVSYKN----QRTPS-FS-------MVTS--QK
[NECTRIA_HAEMATOCOCCA_MPVI_77-13-4]/1-699           IPAASLTAMS-----------NELGIKSPVTFKN----QRTAS-FSRDTMLSSA--QK
NCU07705/1-677                                      IPSPQVAPTI--N--GVNTVKSPSTLKS------SRAPN-FSREGILGSA--QK
[NEUROSPORA_TETRASPERMA_FGSC_2508]/1-677            IPSPQIAPTI--N--GVNTVKSPSTLKS------ARAPN-FSREGILGSA--QK
[SORDARIA_MACROSPORA_K-HELL]/1-710                  IPSPQIAPTV--N--GVNTIKSPSTLKS------ARAPN-FSREGILGSA--QK
[CHAETOMIUM_QLOBOSUM_CBS_148.51]/1-704              IPSPQLAAGS--N--GAGLLKSPNSLKA------ARAASNFSREGILGSA--QK
[PODOSPORA_ANSERINA_S_MAT+]/1-706                   VPSPQLLAQVQINGGGVNSLKSPTSLKS------ARTPS-FSREGILGSA--QK
[VERTICILLIUM_ALBO=ATRUM_VAMS.102]/1-517            VPSPSLTAVN-----------GTHPLKSPSSLKN----HRTPS-FSRDGLISAV--QK
[GLOMERELLA_QRAMINICOLA_M1.001]/1-692               VPSPSMTN-------------GIHPLKSPTSLKT----QRTPS-FSRDGILGSA--QK
[METARHIZIUM_ANISOPLIAE_ARSEF_23]/1-682             -------------------MNTSPDGLKV--NQTLG-AGRDKAHNPM--SR
[BOTRYOTINIA_FUCKELIANA_B05.10]/1-535               ISSPQLSIVT-----------NSDLTSPTSLKSPNGRRIAT-FSREGILGSA--QK
[SCLEROTINIA_SCLEROTIORUM_1980]/1-688               IPSPQISLVS-----------NGDLTSPTSLKSPGTRRIAT-FSREGILGSA--QK
[GROSMANNIA_CLAVIQERA_KW1407]/1-696                 AGSPQRSVG-----------LGRDGILSAP---
AN5808/1-632                                        -----------------------------
[ASPERGILLUS_FUMIGATUS_AF293]/1-633                 -----------------------------
[ASPERGILLUS_ORYZAE_RIB40]/1-638                    -----------------------------
[PENICILLIUM_CHRYSOGENUM_WISCONSIN_54-1255]/1-671   -----------------------------
[ASPERQILLUS_NIQER]/1-651                           LSTLPDANSF-------ILKSALTSPHLLDSPNGL------FSGGGRLSNPFKKR
[PYRENOPHORA_TERES_F._TERES_0-1]/1-712              LSTLPDASSF-------LIKSALRSPHLLESPNGL------FSGCGGLSNPFRKR
[LEPTOSPHAERIA_MACULANS_IN3]/1-710                  -----------------------------
[TALAROMYCES_STIPITATUS_ATCC_105001]/1-603          -----------------------------
NCU00808/1-551                                      -----------------------------
TRICHODERMA_REESEI_CLR-1_PROTEIN/1-758              TSGQAHGLGSRSTGSFSINGSGVAGPGAGAGAGASTTNAMARHHPHDAS
                                                    CONSERVATION

QUALITY

CONSENSUS                                           IPSPQLAA+S--NG-GVNTLKSP+SLKSPNGARTPS-FSREGILGSAF-QK
```

*FIG. 21 CONTINUED*

```
                                                         110       120       130       140       150
                                                          |         |         |         |         |
[GIBBERELLA_ZEAE_PH-1]/1-696                         ARHLSQSSDNNRPD-N---------------------MSNGGQKVSS
[NECTRIA_HAEMATOCOCCA_MPVI_77-13-4]/1-699            PRHLSQSSE-NRTD--T--------------------MTNGTQKLPS
NCU07705/1-677                                       ARNLSQSSE-NRPDHVN--------------------VSNGFHKAPS
[NEUROSPORA_TETRASPERMA_FGSC_2508]/1-677             ARNLSQSSE-NRPDNVN--------------------VSNGFQKAPS
[SORDARIA_MACROSPORA_K-HELL]/1-710                   ARNLSQSSE-NRPDNVN--------------------VSNGYQKAPS
[CHAETOMIUM_QLOBOSUM_CBS_148.51]/1-704               ARNLSQSSD-NRPD--G--------------------VPNGIPKSTS
[PODOSPORA_ANSERINA_S_MAT+]/1-706                    ARNLSQSSD-NRPE-----------------------SNGMQKAPS
[VERTICILLIUM_ALBO-ATRUM_VAMS.102]/1-517             ARNMSQSSD-QRIN--G--------------------FSD-MNKTPS
[GLOMERELLA_QRAMINICOLA_M1.001]/1-692                ARNMSHSSE-NRPE--A--------------------LANGMDKAPS
[METARHIZIUM_ANISOPLIAE_ARSEF_23]/1-682              SRLLFQPPDTA--------------------------PATPLQLANS
[BOTRYOTINIA_FUCKELIANA_B05.10]/1-535                ARNLSQSSA-DRESITNALQSRQNHNHNQNRNGNGNTNGNGNQNGNS
[SCLEROTINIA_SCLEROTIORUM_1980]/1-688                ARNLSQSSA-DRESIINGLQNRQNQNHNQ--------NGNHNQNGHS
[GROSMANNIA_CLAVIQERA_KW1407]/1-696                  ---SSDGSDVNSPS-----------------------LAGTIGAAPP
AN5808/1-632                                         ---MSSSPERDR-------------------------EGILDSTSA
[ASPERGILLUS_FUMIGATUS_AF293]/1-633                  ---MTPSPERDI-------------------------VLDSATAGGT
[ASPERGILLUS_ORYZAE_RIB401]/1-638                    ---MSPSPQRDRDTH----------------------VEAVAAVTAS
[PENICILLIUM_CHRYSOGENUM_WISCONSIN_54-1255]/1-671    ---MTLPPENET-------------------------VDPIGDYAV
[ASPERQILLUS_NIQER]/1-651                            ---MS-CQELDSDTILD--------------------
[PYRENOPHORA_TERES_F._TERES_0-1]/1-712               PRNMSQSSGTDREMSNENTP-----------------PA-SNGIAPT
[LEPTOSPHAERIA_MACULANS_IN3]/1-710                   PRNMSQSSGTDREMSSD-TP-----------------PAQTNGIAPT
[TALAROMYCES_STIPITATUS_ATCC_10500]/1-603            -----------------------------------------------
NCU00808/1-551                                       -----------------------------------------------
TRICHODERMA_REESEI_CLR-1_PROTEIN/1-758               SLSLALTPEVDDL------------------------DVDADASANG
                   CONSERVATION                      ---000100-00-------------------------000000001

QUALITY

CONSENSUS                         ARNLSQSSE++RPDIVN-++RQN-N--NHNQ------VSNGNQKAPS
```

FIG. 21 CONTINUED

```
                                                        310        320        330        340        350
                                                         |          |          |          |          |
[GIBBERELLA_ZEAE_PH-1]/1-696                            LDGDNLIL-SANAAT-FSS-IPNGGFGTWSAQPVGT---------N
[NECTRIA_HAEMATOCOCCA_MPVI_77-13-4]/1-699               LSGDNLVM-AVNPTN-FVS-IPNGGFGTWSAQPIGT---------N
NCU07705/1-677                                          LSGDNLMMQNPDAAG-FVSVIPSGGLGTWSATAT-N---------S
[NEUROSPORA_TETRASPERMA_FGSC_2508]/1-677                LSGDNLMMQNPDAAG-FVSVIPSGGLGTWSATAT-N---------S
[SORDARIA_MACROSPORA_K-HELL]/1-710                      LSGDNLMMQNPDAAC-FVSVIPSGGLGTWSATAT-N---------N
[CHAETOMIUM_QLOBOSUM_CBS_148.51]/1-704                  LSGDNLMRNANNE--FVSIIPSGGLGTWSATAT-N----------N
[PODOSPORA_ANSERINA_S_MAT+]/1-706                       LSGDNLMGIGSNAAN-FVSVIPSGGLGTWSATAT-N---------N
[VERTICILLIUM_ALBO=ATRUM_VAMS.102]/1-517                ----------------------------------------------
[GLOMERELLA_QRAMINICOLA_M1.001]/1-692                   LNGESIMG-VSGSGN-IVSVIPNGGLGTWNNP--T-----------N
[METARHIZIUM_ANISOPLIAE_ARSEF_23]/1-682                 SGGDQALL--SNSSN-TAPTIPNGGLGTWVSVPTGT----------N
[BOTRYOTINIA_FUCKELIANA_B05.10]/1-535                   ASGEDLLM--AASGG-FASMIPATGLGTWAIP--T-----------N
[SCLEROTINIA_SCLEROTIORUM_1980]/1-688                   TSGDDLMI--AANGG-FVSLLPATGLGTWTNP--T-----------N
[GROSMANNIA_CLAVIQERA_KW1407]/1-696                     STLWPSIA--AETSP-FVSVVPASTIGTWSST--T-----------S
AN5808/1-632                                            VGSDDTVAKASTHLAVTGRTTSIVGLASWANPPT------------N
[ASPERGILLUS_FUMIGATUS_AF293]/1-633                     AGSDDAVAKASTIAA-MSGRTSVAGLGSWVNPPT-------------S
[ASPERGILLUS_ORYZAE_RIB401]/1-638                       IGGEDTPVKTSSVAV-MSGKTSVVGLASWVNPPT-------------S
[PENICILLIUM_CHRYSOGENUM_WISCONSIN_54-1255]/1-671       IGSDDPSSKASSSGLPVHGKLSAVGLGSWVNLPASL-----------S
[ASPERQILLUS_NIQER]/1-651                               ISSDDAVSLAN-----IPTRTIAVGLGSWANPPT-------------S
[PYRENOPHORA_TERES_F._TERES_0-1]/1-712                  ---DDFLARSTGHIPHLGMVQPINGIGTWTNHPS-------------N
[LEPTOSPHAERIA_MACULANS_IN3]/1-710                      ---EDFLGRSTGTMSHLGMVQPINGIGTWTNHPL-------------N
[TALAROMYCES_STIPITATUS_ATCC_10500]/1-603               LHVHDAVTPRSQQSVAIVDMHSQTWSSSHLNAPS-------------D
NCU00808/1-551                                          ITPRPTLCPHPDELDNANNL-------FDGIGGAMHAPSSSVSVSGRRHPDDNMD E
TRICHODERMA_REESEI_CLR-1_PROTEIN/1-758                  FSNHQRLPPLSRSRT-------FDGIGGAMHAPSSSVSVSGRRHPDDNMD----N
                                        CONSERVATION
                                                        00010000-010000-000000010021100 0---------1

QUALITY

CONSENSUS       LSGDDLMMKASN+A+HFVSVIP+GGLGTWSNPPTGT----------N
```

FIG. 21 CONTINUED

```
                                                          520         530         540         550
                                                           |           |           |           |
[GIBBERELLA_ZEAE_PH-1]/1-696                          ----PPGLQYFTAAWSLLPGL---MTANSVVAAQCHLLAAAYHFYLVRPMEA
[NECTRIA_HAEMATOCOCCA_MPVI_77-13-4]/1-699             ----PPGLQYFTAAWSLLPGM---MTANSVVAAQCHLLAAAYHFYLVRPMEA
NCU07705/1-677                                        ----PPGLQYFTAAWALLPGM---MTSNSVLAAQCHLLAAAYLFYLVRPLEA
[NEUROSPORA_TETRASPERMA_FGSC_2508]/1-677              ----PPGLQYFTAAWALLPGM---MTSNSVLAAQCHLLAAAYLFYLVRPLEA
[SORDARIA_MACROSPORA_K-HELL]/1-710                    ----PPGLQYFTAAWALLPGM---MTSNSVLAAQCHLLAAAYLFYLVRPLEA
[CHAETOMIUM_QLOBOSUM_CBS_148.51]/1-704                ----PPGLQYFTAAWSLLPGM---MTSNSVLAAQCHLLAAAYLFYLVRPLEA
[PODOSPORA_ANSERINA_S_MAT+]/1-706                     ----PPGLQYFTAAWSLLPGM---MTSNSVLAAQCHLLAAAYLFYLVRPLEA
[VERTICILLIUM_ALBO=ATRUM_VAMS.102]/1-517              ----PPGLQYFTAAWALLPGM---MTSNNVLAAQCHLLASAYLFYLVRPLEA
[GLOMERELLA_QRAMINICOLA_M1.001]/1-692                 ----APGLQYFTAAWALLPGM---MTSNNVLAAQCHLLASAYLFYLVRPLEA
[METARHIZIUM_ANISOPLIAE_ARSEF_23]/1-682               ----PPGLQYFTAAWSLLPGM---ITTNNVLAAQCHLLAAAYLFYLVRPLEA
[BOTRYOTINIA_FUCKELIANA_B05.10]/1-535                 ------------------------------------------------
[SCLEROTINIA_SCLEROTIORUM_1980]/1-688                 ----PPGLPYFAAAWALLPSL---MTRSSVLSAQCTVLASAYLFYLVRPLEA
[GROSMANNIA_CLAVIQERA_KW1407]/1-696                   ----PPGLSYFTAAWALLPAM---MTSNSVLAAQCHLLAAVLFYLVRPLEA
AN5808/1-632                                          ----PPGVPYFIAAWNLLPSV---MMRNSVVAAQCIILAAAYLFYLVRPLEA
[ASPERGILLUS_FUMIGATUS_AF293]/1-633                   ----PPGLPYFAAAWNLLPSV---MMRNSVLAAQCIILASAYLFYLVRPLEA
[ASPERGILLUS_ORYZAE_RIB40]/1-638                      ----APGLPYFAAAWDLLPIV---MMRNSVPAAQCIILASAYLFYLVRPLEA
[PENICILLIUM_CHRYSOGENUM_WISCONSIN_54-1255]/1-671     ----PPGLPYFAAAWSFLPSV---MMRNTVIAAQCMVMASAYLFYLVRPLEA
[ASPERQILLUS_NIQER]/1-651                             ----LPGLSYFSAAWTLLPAV---MTRNSVLAAQCVILASAYLFYMVRPLEA
[PYRENOPHORA_TERES_F._TERES_0-1]/1-712                ----LPGLAYFAAAWSLLPTV---MTRNNMVAAQCQILAAAYIVYLVRPVEA
[LEPTOSPHAERIA_MACULANS_IN3]/1-710                    ----LPGMAYFAAAWNLLPTV---MTRNNMVAAQCQILAAAYIVYLVRPVEA
[TALAROMYCES_STIPITATUS_ATCC_10500]/1-603             ----PPGMDYMQYAMPTLLSVSAWSFSSSMLAAHALVLASVYFAYIVRPLQS
NCU00808/1-551                                        TYRATGDMYFESALKKLYVA---HMDVSSIATQCLFFVALYFAFLRRPLQA
TRICHODERMA_REESEI_CLR-1_PROTEIN/1-758                QTYNDSQIFFQAAQKRIGIL---LVRSDIVGAQCLFLSGVYLMMVFQPVYA

CONSERVATION          ---01200210030002001---000120021201112131111012112

QUALITY

CONSENSUS             ----PPGLQYFTAAW+LLPGM---MT+NSVLAAQCHLLAAAYLFYLVRPLEA
```

*FIG. 21 CONTINUED*

```
                                                    820          830          840          850          860
                                                     |            |            |            |            |
[GIBBERELLA_ZEAE_PH-1]/1-696                        --QVLD--PAVRENCHKCLEASLRQLEHIHE---HHAGHMPYIWQGALSMV
[NECTRIA_HAEMATOCOCCA_MPVI_77-13-4]/1-699           --AVLD--PAVRENCHKCLEASIRQLEHIHE---HHAGHMPYIWQGALSMV
NCU07705/1-677                                      --AILD--PSVRDACTKCLEASIRQLEHISA---H----------------
[NEUROSPORA_TETRASPERMA_FGSC_2508]/1-677            --AILD--PSVRDACTKCLEASIRQLEHISA---H----------------
[SORDARIA_MACROSPORA_K-HELL]/1-710                  --AILD--PSVREACTKCLEASIRQLEHISA---HHAGHMPYLWQGALSIV
[CHAETOMIUM_QLOBOSUM_CBS_148.51]/1-704              --AILD--PAVRDSCTKCLEASVRQLEHIAA---HHAGHMPYLWQGALSIV
[PODOSPORA_ANSERINA_S_MAT+]/1-706                   --AVLD--PSVREACTKCLEASIRQLEHITA---HHAGHMPYLWQGALSIV
[VERTICILLIUM_ALBO-ATRUM_VAMS.102]/1-517             --AILD--PAVRDSCHKCLEASVRQLEHISA---HHAGHMPYLWQGALSIV
[GLOMERELLA_QRAMINICOLA_M1.001]/1-692               --AVLD--PAVRDSCHKCLEASIRQLEHISQ---HHAGHMPYIWQGALSIV
[METARHIZIUM_ANISOPLIAE_ARSEF_23]/1-682              --AVLD--PAVRECCHKCLEASVRQLEHVTE---HHAGHMPYIWQGTLSMM
[BOTRYOTINIA_FUCKELIANA_B05.10]/1-535               -----------------------------------HAGHMPYLWQGALSIV
[SCLEROTINIA_SCLEROTIORUM_1980]/1-688                --AAMD--P--------------------------HAGHMPYLWQGALSIV
[GROSMANNIA_CLAVIQERA_KW1407]/1-696                 QAVMLE--PAVRAACHHCLESAVRQLENVTA---NQDGHMPYLWQAALSFT
AN5808/1-632                                        --ASGD--SWVRECCRRCLEATLYQLESVTT---HREGHLPYLWQGALSMV
[ASPERGILLUS_FUMIGATUS_AF293]/1-633                 --AATD--QVVRECCRRCLEATLRQLENITS---HREGHLPYLWQGALSMV
[ASPERGILLUS_ORYZAE_RIB40]/1-638                    --TSLD--PVVKECCRRCIEATHQLENITS---HREGHLPYLWQGALSMV
[PENICILLIUM_CHRYSOGENUM_WISCONSIN_54-1255]/1-671   --AGAD--PGVIECCRRCLDATLRQLEHITS---HREGHLPYLWQGALSMV
[ASPERQILLUS_NIQER]/1-651                           --ACSD--PTVKDCCLRCLDATLNQLEHIDR---HREGHLPYLWQGALSMV
[PYRENOPHORA_TERES_F._TERES_0-1]/1-712              --LAMD--SGVQDNCHKCLEACVRQLEYITA---HHAGHIPYLFQGALSII
[LEPTOSPHAERIA_MACULANS_IN3]/1-710                  --LAMD--SSVQDNCHKCLEACVRQLEYITA---HHAGHLPYLFQGALSII
[TALAROMYCES_STIPITATUS_ATCC_10500]/1-603           --KRAP--RSMVEKAAICIESCRWYIHHTTK---VLGRPSQYTWTFALSSL
NCU00808/1-551                                      ----------VLLAACRISLLK---------------------------DLI
TRICHODERMA_REESEI_CLR-1_PROTEIN/1-758              --TRRPVKPAVAEFAKRGLETHMHQV-HVNKPGFHHRHGSMFMIRACTRS
                                                    CONSERVATION
                                                    -0000--0010002001200001122100----0000000010100011200

QUALITY

CONSENSUS
                                                    --A+LD--PAVRE+CHKCLEASIRQLEHITA---HHAGHMPYLWQGALSIV
```

```
                                                              870        880        890        900        910
                                                               |          |          |          |          |
[GIBBERELLA_ZEAE_PH-1]/1-696                          SQTLLIMGATMS--PSLLNILLTLVPSREALDQIINDVVMEVERYA------
[NECTRIA_HAEMATOCOCCA_MPVI_77-13-4]/1-699             SQTLLIMGASMS--PSLLGILLTLVPHREALDQIINEVVLEVERYA------
NCU07705/1-677                                        ------------------ILVSLVSHRDVIDQIINDVVMEIERYS------
[NEUROSPORA_TETRASPERMA_FGSC_2508]/1-677              ------------------ILVSLVSHRDVIDQIINDVVMEIERYS------
[SORDARIA_MACROSPORA_K-HELL]/1-710                    SQTLLIMGATMS--PSLNSILVSLVSHRDVIDQIINDVVMEIERYS------
[CHAETOMIUM_QLOBOSUM_CBS_148.51]/1-704                SQTLLVMGATMS--PSLSSILWSLVPHREAIDQIINDVVMEIERFA------
[PODOSPORA_ANSERINA_S_MAT+]/1-706                     SQTLLVMGATMS--PSLSSILWSLVPHRDTIDQIINDVVMEIERYA------
[VERTICILLIUM_ALBO=ATRUM_VAMS.102]/1-517              SQALLVMGATMS--PSLGSILLTLCGSREAIDQIINDVVMEVERYS------
[GLOMERELLA_QRAMINICOLA_M1.001]/1-692                 SQTLLVMGATMS--PSLSSILLTLVPHRETIDQIINDVVMEIERYS------
[METARHIZIUM_ANISOPLIAE_ARSEF_23]/1-682               AQTLLLMGSSMS--PSLMGILLTIVPHQKALDDLINEVIMEVQNYA------
[BOTRYOTINIA_FUCKELIANA_B05.10]/1-535                 SQTLLVMGATMS--PSLSAIINSLVIH-DTIDGIINDVVMEIERYA------
[SCLEROTINIA_SCLEROTIORUM_1980]/1-688                 SQTLLVMGATMS--PSLSAIINSLVIH-DTIDGIINDVVMEIERYA------
[GROSMANNIA_CLAVIQERA_KW1407]/1-696                   SQALLVMGASMS--PSLADILLSIVPSRAMLDQLMANVVAETARYA------
AN5808/1-632                                          SQSLLIMGATMS--PALSSLI---PPTLRVDEIISSVIVEVDRYA-------
[ASPERGILLUS_FUMIGATUS_AF293]/1-633                   SQTLLIMGASMS--PGLSSLI---PPGFRVDAIISSVMAEVERYA-------
[ASPERGILLUS_ORYZAE_RIB40]/1-638                      SQTLLIMGATMS--PTLSALL---PPADQVDRMISEVVAEVERYA-------
[PENICILLIUM_CHRYSOGENUM_WISCONSIN_54-1255]/1-671     SQTLLIMGATMS--PTLSILL---PPVAQIDAIIAGVVNEVERYA-------
[ASPERQILLUS_NIQER]/1-651                             SQALLIMGATMS--PTLSSLL---PPATQLDGIISGVITEVGRYA-------
[PYRENOPHORA_TERES_F._TERES_0-1]/1-712                SQTLLIMGATMT--PSLSQLI---PPPATMDDIINNVLEMERYA-------
[LEPTOSPHAERIA_MACULANS_IN3]/1-710                    SQTLLIMGATMT--PSLSQLI---PPPATMDDIINNVLEMERYA-------
[TALAROMYCES_STIPITATUS_ATCC_10500]/1-603             GAIIILTLGSLN--RDLQAFV---P---DIDELQTMAIDNFRPWA------
NCU00808/1-551                                        GPEILQAGS------HLRELL---VGWQKVQGDPS----------------
TRICHODERMA_REESEI_CLR-1_PROTEIN/1-758                ALVLLAAAKAGCAMPT--------DWEDSVYKTVGMLAYWEDEDRD

CONSERVATION                                          20022001011110020012-----000026733550110000020-----

QUALITY

CONSENSUS                                             SQTLLIMGATMS--PSLSSILLSLVPHRDTIDQIINDVVMEVERYA------
```

```
                                                                    920         930         940         950
                                                                     |           |           |           |
[GIBBERELLA_ZEAE_PH-1]/1-696                                       --TLAPSLSLASEMLKEAE-YCFSIISPRVLD-------------
[NECTRIA_HAEMATOCOCCA_MPVI_77-13-4]/1-699                          --TLAPSLSLAAEIIKEAE-VRRRAFLGTP---------------
NCU07705/1-677                                                     --VLSPSLSLSAEIIKEAE-VRRRTFLSG----------------
[NEUROSPORA_TETRASPERMA_FGSC_2508]/1-677                           --VLSPSLSLSAEIIKEAE-VRRRTFLSG----------------
[SORDARIA_MACROSPORA_K-HELL]/1-710                                 --VLSPSLSLSAEIIKEAE-VRRRTFLSG----------------
[CHAETOMIUM_QIOBOSUM_CBS_148.51]/1-704                             --VLSPSLSLSAEIIKEAE-VRRRTFLSG----------------
[PODOSPORA_ANSERINA_S_MAT+]/1-706                                  --VLSPSLSLSAEIIKEAE-VRRRTYLSG----------------
[VERTICILLIUM_ALBO=ATRUM_VAMS.102]/1-517                           --NLAPSISLAAEIIKEAE-VRRRAFLSG----------------
[GLOMERELLA_QRAMINICOLA_M1.001]/1-692                              --TLAPSISLAAEIIKEAE-VRRRAYLSG----------------
[METARHIZIUM_ANISOPLIAE_ARSEF_23]/1-682                            --SLAPSLRIAVEIIKEAE-LSNITNEARLLRLA------------
[BOTRYOTINIA_FUCKELIANA_B05.10]/1-535                              --HLAPSLSLSAEIIREAE-MRRRSYLGG----------------
[SCLEROTINIA_SCLEROTIORUM_1980]/1-688                              --HLAPSLSLSAEIIREAE-MRRRSYLGG----------------
[GROSMANNIA_CLAVIQERA_KW1407]/1-696                                --ILAPSLSLAADIVRQAE-ARRREYLGG----------------
AN5808/1-632                                                       --HLAPSLKLSSEILRDAE-RRRQICLRSSGSRV------------
[ASPERGILLUS_FUMIGATUS_AF293]/1-633                                --HLAPSIKLSAEIIRDAE-KRRQICLRSTSRRV------------
[ASPERGILLUS_ORYZAE_RIB40]/1-638                                   --HLAPSIKLSAEIIRDAE-KRRQICLRSTGRCT------------
[PENICILLIUM_CHRYSOGENUM_WISCONSIN_54-1255]/1-671                  --HLAPSIKLSAEIIRDAE-TRRQICLRSANMCL------------
[ASPERQILLUS_NIQER]/1-651                                          --RLAPSLKLSAEIIRDAE-KRRQVSLASAARRG------------
[PYRENOPHORA_TERES_F._TERES_0-1]/1-712                             --HLAPSLRLSAEIIREAE-GKRQMWLRTAGLKFEV----------
[LEPTOSPHAERIA_MACULANS_IN3]/1-710                                 --HLAPSIRLSAEIIREAE-GKRQIWLRTAGLKFEV----------
[TALAROMYCES_STIPITATUS_ATCC_105001]/1-603                         ----FSSIEAVVSILEDIR-KKRRLLLQV-----------------
NCU00808/1-551                                                     -------SPSVNQSIHIIKEAERFIRQVYKGGKDEEQGRIEE----
TRICHODERMA_REESEI_CLR-1_PROTEIN/1-758                             LIHWRSTLEREIALTRHE---------------------------

CONSERVATION

QUALITY

CONSENSUS                          --HLAPSLSLSAEII+EAE-VRRRT+LSGAGRR+EV----------
```

*FIG. 21 CONTINUED*

```
                                                            310        320        330        340        350
                                                             |          |          |          |          |
AN6832/1-704                                              NFSI-SPTVPRQQPEEPLS---------------------------PLSTT
[PENICILLIUM_MARNEFFEI_ATCC_18224]/1-745                  NSHL-SHVPKDQRQHH-----------------------------RRSSI
[TALAROMYCES_STIPITATUS_ATCC_10500]/1-749                 DSHL-SRLSSKDQRRQH----------------------------HRHQE
AN3369/1-773                                              AAYF-ASTPPSAPRRGSVADLSSSEGQSWAAHDQ-----------PGTPP
[ASPERGILLUS_NIGER_CBS_513.88]/1-777                      LSHL-SRAPATGVRRESVMDIASPEAQAWQVFGSQPH--------HGTST
[ASPERGILLUS_ORYZAE_RIB40]/1-771                          LSYF-SHPSTNTDSRDSALGYSPAEAQPWPVQESQQ---------PITPP
[PENICILLIUM_CHRYSOGENUM_WISCONSIN_54-1255]/1-767         ASYF-SRTPVNEQE---------DAIGWPHRA-------------PVTPP
[COCCIDIOIDES_IMMITIS_RS]/1-757                           SQHF-SRAPDPQPFAKR-EKQPLPDNCSWSLQ-------------PPPST
[COCCIDIOIDES_POSADASII_C735_DELTA_SOWQP]/1-794           SQHF-SRAPDPQPLPKR-EKQPLPDNCSWSLQ-------------PPPST
NCU08042/1-812                                            RSSL-AAPLNSIEISHN--------------FPAIRQKSSSQ---KDPQ
[NEUROSPORA_TETRASPERMA_FGSC_2508]/1-834                  RSSL-AAPLNSIEISHN--------------FPAIRQKSSTQ---KDPQ
[SORDARIA_MACROSPORA_K-HELL]/1-803                        RSSL-AAPLNSVEISHN--------------FPAIRQKSSTQ---KDPQ
[PODOSPORA_ANSERINA_S_MAT+]/31-822                        RNSL-AAPLNGVEMSHN--------------YPAIRQKPTTQ---KDPQ
[GLOMERELLA_GRAMINICOLA_M1.001]/1-751                     RNSL-TTPLHSAEVMHN--------------FPSLRQKSAVT---KDTQ
[MAGNAPORTHE_ORYZAE_70-15]/1-781                          RSTL-SAPLNTGEMPHN--------------YPSTKSRAGTH---KDPQ
[NECTRIA_HAEMATOCOCCA_MPVI_77-13-4]/1-647                 RTSL-ASLQRNGSKRTL--------------ELPSPQTGQ-----LEETA
TRICHODERMA_REESEI/1-608                                  QLLL-ASQPSADSSSDDNTRSK---VPLIRAASRSA---------KKQF
[VERTICILLIUM_ALBO-ATRUM_VAMS.102]/1-829                  RNAL-ATPRNMAAATGAIAVQP---------EAMRRASAVE----SKPAA
[PYRENOPHORA_TRITICI-REPENTIS_PT-1C-BFP]/1-642            -------------------------------------------------
[PYRENOPHORA_TERES_F._TERES_0-1]/1-787                    RSFI-SNNNQETALPSRASSPPPGLIT------------------DDRPD
[LEPTOSPHAERIA_MACULANS_IN3]/189-976                      RLLI-AHNSQETALPSRAGSPPPELA-------------------DNNPL
NCU07007/1-768                                            QSQT-SRSRAMPTSATSLASSRYSSLQQPRSESGRQDPLNGGVKAGSRGH

CONSERVATION                                              0000-100000000000000----------0-------------0000

QUALITY

CONSENSUS                                                 RSSL-SRPPNSQE++HNAASQPPE+P+WRQKSSTQ----------PKDPQ
```

*FIG. 22 CONTINUED*

```
                                                    410        420        430        440        450
                                                     |          |          |          |          |
AN6832/1-704                                        ALRDTVLAI----GSIIAAVDVNDRTHCTYFESAMSRLNLGSIGNPSLEVV
[PENICILLIUM_MARNEFFEI_ATCC_18224]/1-745            ALLNIILAL----GS-ITAAGVDNHNHRTYFERSMSFLNFKILGNPSLEVV
[TALAROMYCES_STIPITATUS_ATCC_10500]/1-749           ALLNIIFAL----GS-ITAAGVDNHNHRTYFERSKSYLNINTLGNPSLEVV
AN3369/1-773                                        CLLNIVLAM----GS-ICASTCDDISHKIYYSRCRAYLDLESLASLHLETV
[ASPERGILLUS_NIGER_CBS_513.88]/1-777                ALLNIVFAL----GS-IAATPADDMSHQAYMRSMSHLNLESLGSPHVETI
[ASPERGILLUS_ORYZAE_RIB40]/1-771                    ALLNIVLAL----GS-IAACPSDDMSHTIYAQRCKSYLNLESLGSSHIETI
[PENICILLIUM_CHRYSOGENUM_WISCONSIN_54-1255]/1-767   ALLNIVLAL----GC-IAATGPDDTTHQTYFLRCKSHLTLTSLGSSHIETI
[COCCIDIOIDES_IMMITIS_RS]/1-757                     ALQNIVFAL----GS-IAAYTADDTSHESYLKARHYLSLDTLGNPHLETI
[COCCIDIOIDES_POSADASII_C735_DELTA_SOWGP]/1-794     ALQNIVFAL----GS-IAAYTADDTSHESYLKARHYLSLDTLGNPHLETI
NCU08042/1-812                                      ALLNMVFAM----GS-IVAMKSDDYNHVNYNRAMEHLPMDSFGSSHIETV
[NEUROSPORA_TETRASPERMA_FGSC_2508]/1-834            ALLNMVFAM----GS-IVAMKSDDYNHVNYNRAMEHLPMDSFGSSHIETV
[SORDARIA_MACROSPORA_K-HELL]/1-803                  ALLNMVFAM----GS-IVAMKSDDYNHVNYNRAMEHLPMDSFGSSHIETV
[PODOSPORA_ANSERINA_S_MAT+]/31-822                  ALLNMVFAM----GS-IAAMKSDDYNHINYNRAMEHLPMDAFGSSHIETV
[GLOMERELLA_GRAMINICOLA_M1.001]/1-751               ALLNMIFAM----GS-IVAMKSDDYNHINYYNRAMEYLPIDAFGSSHIEMV
[MAGNAPORTHE_ORYZAE_70-15]/1-781                    ALLNMVFAM----GS-IVAMKSDDYNHVTYNRAMEHLPMDAFGSSHIETV
[NECTRIA_HAEMATOCOCCA_MPVI_77-13-4]/1-647           SLLNMVFAM----GA-IMATKSSDLDHFKFYEKAMKHLSMGAFGSSHIETV
TRICHODERMA_REESEI/1-608                            SLLNMVFAT----SS-IMSTPSSNLSHIKYYNQAIEHIHLSAFGSSHIETI
[VERTICILLIUM_ALBO-ATRUM_VAMS.102]/1-829            ALHAVLAM-----GS-IAATKSSDLHHEQLYQQAMTHLTIDSFGSSRVETV
[PYRENOPHORA_TRITICI-REPENTIS_PT-1C-BFP]/1-642      ALLNMVFAL----GS-LASQAADNETHHIYFTRSRKHLSLESFGSGNLEVL
[PYRENOPHORA_TERES_F._TERES_0-1]/1-787              ALLNMVFAL----GS-LSSQAADNEAHHIYFTRSRKHLSLESFGSGNLEVL
[LEPTOSPHAERIA_MACULANS_IN3]/189-976                GLLNTVFAL----GS-LSSSTADNEAHYVFTRARQHVSLESFGSGNLEVL
NCU07007/1-768                                      ALLYMIIATVYRTNSPSTPSETSAETSERYFQWAKDLVMPQFLISSSLETV

CONSERVATION    7*54598*6----77-5564257522423763475249153487944 9*69

QUALITY

CONSENSUS                                           ALLNMVFAL----GS-IAAMKSDDYNH++YYNRAMEHL-LDSFGSSH+ETV
```

*FIG. 22 CONTINUED*

```
                                                                     470         480         490         500
                                                                      |           |           |           |
AN6832/1-704                                             QTLGLMGGWYCHYTSQPNLAYSLMGASLRMALTLGLHRELCDGRSVHD---
[PENICILLIUM_MARNEFFEI_ATCC_18224]/1-745                 QTLGLMGGWYCHYISQPNLGYALMGASLRMAVTLGLQREPPFDSHMSA---
[TALAROMYCES_STIPITATUS_ATCC_10500]/1-749                QTLGLMGGWYCHYISQPNLAYALMGASLRMAVTLGLQREPPLDRNLPV---
AN3369/1-773                                             QTLGIGLGGWYLHYVAQPNLAYSLMGAALRMAATMGLHREFADQSDTSN---
[ASPERGILLUS_NIGER_CBS_513.88]/1-777                     QALGLMGGYYLHYSSQPNLAYSMMGAALRMAAALGLHKEVSDGQYGNG---
[ASPERGILLUS_ORYZAE_RIB40]/1-771                         QTLGLLGGQYLHYVSQPNLAYSLMGAALRMAAALGLHKEFSDNQEGSC---
[PENICILLIUM_CHRYSOGENUM_WISCONSIN_54-1255]/1-767        QALGLMGGWYCHYISQPNLAYSVLGAALRMSVALGLHKEFAETRQIPS---
[COCCIDIOIDES_IMMITIS_RS]/1-757                          QTLALMGGHYLHYMSQPNLAHSLMAVALRMATVLGLHKEFIGNQEAAS---
[COCCIDIOIDES_POSADASII_C735_DELTA_SOWGP]/1-794          QTLALMGGHYLHYMSQPNLAHSLMAVALRMATVLGLHKEFIGNQEAAS---
NCU08042/1-812                                           QALALIGGYYLHYINRPNMANAVLGAAIRMASALGLHRESLAQG------
[NEUROSPORA_TETRASPERMA_FGSC_2508]/1-834                 QALALIGGYYLHYINRPNMANAVLGAAIRMASALGLHRESLAQG------
[SORDARIA_MACROSPORA_K-HELL]/1-803                       QALALIGGYYLHYINRPNMANAVLGAAIRMASALGLHRESLTQG------
[PODOSPORA_ANSERINA_S_MAT+]/31-822                       QALALIGGYYLHYINRPNMANAVLGAAIRMASALGLHRESITVGLP----
[GLOMERELLA_QRAMINICOLA_M1.001]/1-751                    QALAIIGGYYLHYINRPNMANAVLGAAIRMASALGLHRESLAQG------
[MAGNAPORTHE_ORYZAE_70-15]/1-781                         QALAIIGGYYLHYTNRPNMANAVLGAGIRMASALGLHRESLTQS------
[NECTRIA_HAEMATOCOCCA_MPVI_77-13-4]/1-647                QALALLGGYYLHYVNRPNMANAILGATIRMASALGLHREPMAGD------
TRICHODERMA_REESEI/1-608                                 HALGLLGGYYLHYINRPNMANAIIGAVLRMATALGLHREPPEEP-----
[VERTICILLIUM_ALBO-ATRUM_VAMS.102]/1-829                 QALALIGGFYLHYINRPNMANAILGAAVRMASALGLHRESLAQGLS----
[PYRENOPHORA_TRITICI-REPENTIS_PT-1C-BFP]/1-642           QALAIMSGYYMHYLNRPNEAHSLMGGTLRMATALGLHREYSERSDASRQTK
[PYRENOPHORA_TERES_F._TERES_0-1]/1-787                   QALAIMSGYYMHYLNRPNEAHSLMGGTLRMATALGLHREYSERSDASQQAK
[LEPTOSPHAERIA_MACULANS_IN3]/189-976                     QTLAIMSGYYMHYLNRPNEAHSLMGGTLRMATALGLHREYSERSGSSRKFT
NCU07007/1-768                                           QLLCLM-IEYLHGSSSQAQLWTHSLAVKSALQIGLHSADASR--------

CONSERVATION                                             ▁▁▁▁▁▁▁▁▁▁▁▁▁▁▁▁▁▁▁▁▁▁▁▁▁▁▁▁▁▁▁▁▁▁▁▁▁▁▁▁▁▁▁▁▁▁▁▁▁
QUALITY                                                  65*9*9274*8*65787757578587699685598***65414120----
CONSENSUS                                                QALALMGGYYLHYINRPN+ANALMGAALRMASALGLHRESLAQ++ASSQ-K
```

```
                                                         620         630         640         650         660
                                                          -           -           -           -           -
AN6832/1-704                                     QESLATPPALTHTEM-------CDLDTQLLQWWNNLPPILRD-SEPYPES-
[PENICILLIUM_MARNEFFEI_ATCC_18224]/1-745         QESLAALPTLTHTEL-------LNLDSQLLQWWNNLPPVLKD-YTPCPEA-
[TALAROMYCES_STIPITATUS_ATCC_10500]/1-749        QDSLAALPTKTYSEM-------LTLDSQLVAWWNNLPPVLKD-CSPCPES-
AN3369/1-773                                     QDALAVSPLTKYSEI-------LHFDTQLIVEWYNSLPYIIKD-HEPCPEG-
[ASPERGILLUS_NIGER_CBS_513.88]/1-777             QEVLAVAPLTKPHEM-------AHLDSQLLEWYDNLPYILKD-HEPCPEG-
[ASPERGILLUS_ORYZAE_RIB40]/1-771                 QEILAAAPLTRYHEM-------SHFDNQLLEWYENLPYILKD-HEPCSES-
[PENICILLIUM_CHRYSOGENUM_WISCONSIN_54-1255]/1-767 QESLAAAPLVKHQEM-------AHADAQLLEWWDNLPSVLKD-HEPCSES-
[COCCIDIOIDES_IMMITIS_RS]/1-757                  GDALAAASPIVSYQEM-------VSLDNQLVEWYDNLPPLLKD-HEPSADP-
[COCCIDIOIDES_POSADASII_C735_DELTA_SOWGP]/1-794  GDALAAASPIVSYQEM-------VSLDNQLVEWYDNLPPLLKD-HEPSADP-
NCU08042/1-812                                   QDMLAISPLLRTEDR-------CNLDGQLVVWYENLPWLLRT-TDPCAEP-
[NEUROSPORA_TETRASPERMA_FGSC_2508]/1-834         QDMLAISPLLRTEDR-------CNLDGQLVVWYNNLPWLLRT-TDPCAEP-
[SORDARIA_MACROSPORA_K-HELL]/1-803               QDMLAITPLLRTEDR-------CAIDAQLVNWYTSLPWLLRT-TDPCAEP-
[PODOSPORA_ANSERINA_S_MAT+]/31-822               QDMLAISPLLRTEDR-------CNLDGQLVNWYSSLPWLLRT-TDPCAEP-
[GLOMERELLA_QRAMINICOLA_M1.001]/1-751            QDMLAVSPLLRTEDR-------CNLDAALVDWYANMPWLLRT-TDPCAEP-
[MAGNAPORTHE_ORYZAE_70-15]/1-781                 HDMLAATSQQTAESL-------QHLDGLLVGWYDKLPSILRN-RESCAEP-
[NECTRIA_HAEMATOCOCCA_MPVI_77-13-4]/1-647        QDMLAVSPLLESEDR-------HHLDSLLVDWHNNLPWLIRS-TEPCVES-
TRICHODERMA_REESEI/1-608                         QDTLAASSLPSTDDR-------QSMDTQLVTWYESLPWLLGT-TQPCAEP-
[VERTICILLIUM_ALBO-ATRUM_VAMS.102]/1-829         QDRLVECPLLSSVET-------ASYDAQLVKWHEDLPSMLSKPDEPCPNF-
[PYRENOPHORA_TRITICI-REPENTIS_PT-1C-BFP]/1-642   QDRLVECPLLSSVEM-------ASYDAQLVKWHEDLPSILSKTDEPCPNF-
[PYRENOPHORA_TERES_F._TERES_0-1]/1-787           QDRLVETPLLSLAET-------AAFDMQIVKWHEELPSILSDLNEPCPDF-
[LEPTOSPHAERIA_MACULANS_IN3]/189-976             YDDNAGGSSLNHVNTFDTLRLAFDFSWKLSQWHQSVPPDLRP-QNLTTETP
NCU07007/1-768
```

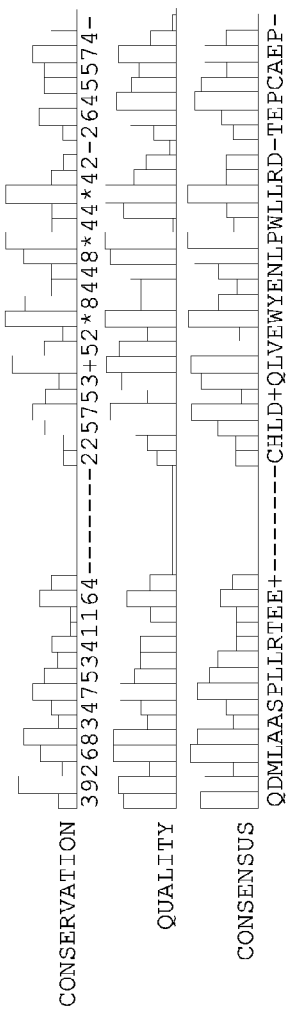

FIG. 22 CONTINUED

```
                                               770         780         790         800         810
                                                |           |           |           |           |
AN6832/1-704                                    -ADERTAIRRCRELAETVILDIAQTTS-----MNRMIGWNAVWFLFQATMVP
[PENICILLIUM_MARNEFFEI_ATCC_18224]/1-745        -DEERVAVQRCREIAEVAIEDISTTTT-AMKMNQMIAWNAVWLVFQATMVP
[TALAROMYCES_STIPITATUS_ATCC_10500]/1-749       -DEERVVVQRCCEIAKMAIEDISGTTTSTIGMNQMIAWNAVWLVFQATMVP
AN3369/1-773                                    -SEERTAIERCREIAETAIRDISATAK----TPQMSGWNAVWFLFQATMVP
[ASPERGILLUS_NIGER_CBS_513.88]/1-777            -SEERTAIERCREIAEATIQDVAAKAQ----FHQMSGWNAVWLIFQAAMVP
[ASPERGILLUS_ORYZAE_RIB40]/1-771                -SEERTAIERCRQIAEATIQDISSTAQ----SHQMSGWSAVWLIFQAVMVP
[PENICILLIUM_CHRYSOGENUM_WISCONSIN_54-1255]/1-767 -SEERTAIEKCREVADESIRNIAATAQ----LNQLCGWNAVWWTFQASLVP
[COCCIDIOIDES_IMMITIS_RS]/1-757                 -TEERYAIERCRMVANETIRDVASTTR----LNQMTGWNAVWLLFQATLVP
[COCCIDIOIDES_POSADASII_C735_DELTA_SOWQP]/1-794 -TEERYAIERCRMVANETIRDVASTTR----LNQMTGWNAVWLLFQATLVP
NCU08042/1-812                                  -DADLAAIETCRELAAATIEDIGREWT----RNQMSGWNAVWFLYQAAMVP
[NEUROSPORA_TETRASPERMA_FGSC_2508]/1-834        -DSDLAAIETCRELAAATIEDIGREWT----RNQMSGWNAVWFLYQAAMVP
[SORDARIA_MACROSPORA_K-HELL]/1-803              -DSDLAAIETCRELAAATIEDIGREWT----RNQMSGWNAVWFLYQAAMVP
[PODOSPORA_ANSERINA_S_MAT+]/31-822              -DADLQAIETCRELAAATIEDVGREWT----RNQMSGWNAVWFLYQAAMVP
[GLOMERELLA_QRAMINICOLA_M1.001]/1-751           -EQDITAIETCRELAKHTIEDIAREWT----RNQMSGWNAVWFLYQAAMIP
[MAGNAPORTHE_ORYZAE_70-15]/1-781                -EHDIAAIETCRDLAQQTIEDIAREWT----RNQMSGWNAVWFLYQAAMIP
[NECTRIA_HAEMATOCOCCA_MPVI_77-13-4]/1-647       -EDDLAAIATCQELARQTIDDVASGWT----KHQMSGWNAVWLLYQAAMIP
TRICHODERMA_REESEI/1-608                        -EQDVAAVKNCQEAARETVDSVSKGWM----RQQMSGWNAVWFLYQAAMIP
[VERTICILLIUM_ALBO-ATRUM_VAMS.102]/1-829        DEEILASINTCSDMAAQTIEDIAKEWT----RNQMLGWNAAWFLYQAAMIP
[PYRENOPHORA_TRITICI-REPENTIS_PT-1C-BFP]/1-642  -ADEKVSVGKCRFIACKTIEDISRDCM----PDLLSGWNAVWFCFQACMVP
[PYRENOPHORA_TERES_F._TERES_0-1]/1-787          -ADEKVSVGKCRLVACKTIEDISRDCM----PDLISGWNAVWFCFQACMVP
[LEPTOSPHAERIA_MACULANS_IN3]/189-976            -PEEKVAVGKCRMIAAKTIQELSKECM----ADLISGWNAVWFCFQACMVP
NCU07007/1-768                                  -RCIRACRECIALAKAIVDRWQNQKV----LLSGAWWLTAYHAFGASLTL
```

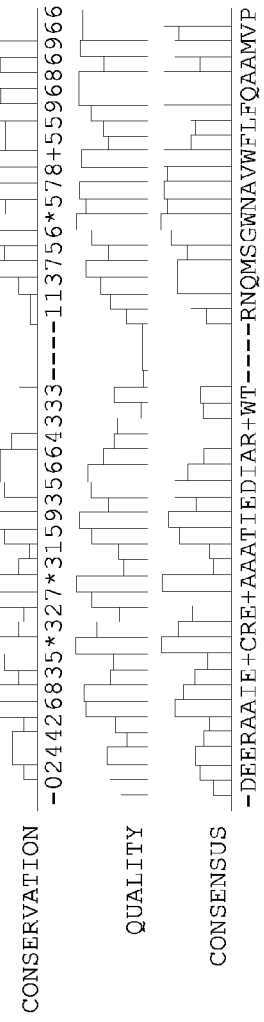

```
                                                           980           990          1000          1010
                                                            |             |            |             |
AN6832/1-704                                               |------------------------------------------------
[PENICILLIUM_MARNEFFEI_ATCC_18224]/1-745                   -GFFDNLPP-----EY------GYTSFGTPVTRC---------------
[TALAROMYCES_STIPITATUS_ATCC_10500]/1-749                  NTSFENYSS-----QHVW----EYLSWGENNDFW---------------
AN3369/1-773                                               SSSFDNFSS-----QHMW----EYLSWGESNDLW---------------
[ASPERGILLUS_NIGER_CBS_513.88]/1-777                       PSTMDDPNG-----QYLW----DFLSWSDT-NIV---------------
[ASPERGILLUS_ORYZAE_RIB40]/1-771                           PQFINDSAG-----QYLW----DFLSWSDS-NLL---------------
[PENICILLIUM_CHRYSOGENUM_WISCONSIN_54-1255]/1-767          PPVIDDSTA-----QYLW----DFLSWSDS-SLW---------------
[COCCIDIOIDES_IMMITIS_RS]/1-757                            TPFADDSGG-----QYLW----EYLSWSDN-NIW---------------
[COCCIDIOIDES_POSADASII_C735_DELTA_SOWQP]/1-794            -PYIQPSP------QQML----DYITWGDN-NIW---------------
NCU08042/1-812                                             -PYIQPSP------QQML----DYITWGDN-NIW---------------
[NEUROSPORA_TETRASPERMA_FGSC_2508]/1-834                   -GMTGVLDH-----GGMW-DLDGMLWGPSPSPSVHHGQHS-THPDD----AV
[SORDARIA_MACROSPORA_K-HELL]/1-803                         -GMTGVLDH-----GGMW-DLDGMLWGPSPSPSVHHGHHS-THPDD----AV
[PODOSPORA_ANSERINA_S_MAT+]/31-822                         -GMMGMLDQ-----GGMW-DLDGMFWGPSPSPP-HHGHHP-THPDD----AV
[GLOMERELLA_QRAMINICOLA_M1.001]/1-751                      -GMMGLLDQ-----GGLW-DLDGMYWGGNGPQS--PTHT-GNPDD-----S
[MAGNAPORTHE_ORYZAE_70-15]/1-781                           -GMMGMLDQ-----HGLW-DLDGMYWGQSPDQS-----------------
[NECTRIA_HAEMATOCOCCA_MPVI_77-13-4]/1-647                  -GMMGVSDQ-----QSLW-DLDGMLWGQHDEFD-----------------
TRICHODERMA_REESEI/1-608                                   -HMVNMLDQ-----EWQW-DIGPGQ------------------------
[VERTICILLIUM_ALBO-ATRUM_VAMS.102]/1-829                   -EVAAFMEQ-----DWMW-DLDGMFWGQQPGTN-----------------
[PYRENOPHORA_TRITICI-REPENTIS_PT-1C-BFP]/1-642             PGWVNTGNDPAILNNFW---DDMWDTNLPDM-------------------
[PYRENOPHORA_TERES_F._TERES_0-1]/1-787                     PGWVNTGNDPAILNNFW---DDMWDTNLPDM-------------------
[LEPTOSPHAERIA_MACULANS_IN3]/189-976                       PTWAN-ANDPTILNNLW---DDMWDTNLPDM-------------------
NCU07007/1-768                                             SSPAVI--------------------------------------------

CONSERVATION  -00000000----0001---0002100-000-
QUALITY       ▁▂▃▂▂▁▃▄▂▃▂▂▂▁▂▂▁▂▃▂▁▁▂▁
CONSENSUS     PGMMGDLDQPAILQ+LW-DLDGMSWGDNPNLWVHHGHHS-THPDD-----AV
```

*FIG. 22 CONTINUED*

```
                                                       1030           1040           1050           1060
                                                         |              |              |              |
AN6832/1-704                                           ------------------------------------------------
[PENICILLIUM_MARNEFFEI_ATCC_18224]/1-745               -------------------------------LDMSIIP---------
[TALAROMYCES_STIPITATUS_ATCC_10500]/1-749              -----------------------------AELYTSLNPQ--------
AN3369/1-773                                           ---------------------------PELYTNLDPQDSQI------
[ASPERGILLUS_NIQER_CBS_513.88]/1-777                   -------------------------PM--ADV--ENINDGLLGS
[ASPERGILLUS_ORYZAE_RIB40]/1-771                       -------------------------QGL-ADI--DNVNGPLFPQ
[PENICILLIUM_CHRYSOGENUM_WISCONSIN_54-1255]/1-767      -------------------------PGI-TDT--NSFNDETLFAQ
[COCCIDIOIDES_IMMITIS_RS]/1-757                        -------------------------PGIVTDV--DGRNDMTLLT
[COCCIDIOIDES_POSADASII_C735_DELTA_SOWQP]/1-794        -----------------------SSVQEDFYTQQPPAVGMFGQ
NCU08042/1-812                                         -----------------------SSVQEDFYTQQPPAVGMFGQ
[NEUROSPORA_TETRASPERMA_FGSC_2508]/1-834               PTVAEYAAAFPTADVVDGFLQHHSAME----FGNMMGHHHHHHAGAHAGQ
[SORDARIA_MACROSPORA_K-HELL]/1-803                     PTVAEYAAAFPTADVVDGFLQHHSAME----FGNMMGHH---HHAGAHAGQ
[PODOSPORA_ANSERINA_S_MAT+]/31-822                     ATAADFAAAFPTADGADGLLHHHSAIE----YGNLMGHH----HADAHTGQ
[GLOMERELLA_QRAMINICOLA_M1.001]/1-751                  AAAAEFAAYAAAQQAASAAHHHPELMQHVDYG-MMHHHHAGHHHV------
[MAGNAPORTHE_ORYZAE_70-15]/1-781                       -----VDFTPYTVNEQ-------MMHMDYG-MMGSQTATIGGDFFIH-
[NECTRIA_HAEMATOCOCCA_MPVI_77-13-4]/1-647              ----------AGAYGFHDNMMMSMDYN-MMGNDIPATTAALDHG
TRICHODERMA_REESEI/1-608                               ------------------------------------------------
[VERTICILLIUM_ALBO-ATRUM_VAMS.102]/1-829               ---------------------PQQQQQHPQQHASLQMHDTN
[PYRENOPHORA_TRITICI-REPENTIS_PT-1C-BFP]/1-642         ---------------------LETPFGIATDYEYVGAAQDP
[PYRENOPHORA_TERES_F._TERES_0-1]/1-787                 ---------------------LETPFGIATDYEYVGAAQDP
[LEPTOSPHAERIA_MACULANS_IN3]/189-976                   ---------------------LETPFGLNNDWEYASTAQDS
NCU07007/1-768                                         ------------------------------------------------

CONSERVATION                                           ------------------------------00--000-----00----

QUALITY

CONSENSUS                                              +T+AEFAAAFPTADV+DG+L+HHSAM+MHMDPG+MGHHT+++AGA+FGQ
```

FIG. 22 CONTINUED

TRANSCRIPTION FACTORS FOR CELLULOSIC ENZYME PRODUCTION

CROSS-REFERENCE TO RELATED APPLICATIONS

This application is a U.S. National Phase patent application of PCT/US2012/047898, filed Jul. 23, 2012, which claims the benefit of U.S. Provisional Application No. 61/510,466, filed Jul. 21, 2011, which are hereby incorporated by reference, in their entireties.

SUBMISSION OF SEQUENCE LISTING AS ASCII TEXT FILE

The content of the following submission on ASCII text file is incorporated herein by reference in its entirety: a computer readable form (CRF) of the Sequence Listing (file name: 416272011100SubSeqList.txt, date recorded: Mar. 29, 2016, size: 995 KB).

FIELD

The disclosure relates to the degradation of cellulose. In particular, the disclosure relates to polypeptides involved in the response of a cell to cellulose, and related nucleotides and compositions. The disclosure further relates to methods and uses of polypeptides, nucleotides, and compositions thereof involved in the response of a cell to cellulose.

BACKGROUND

Liquid fuels derived from biomass have long been studied as alternatives to fossil fuels. While the net energy yield and greenhouse gas reduction achieved with current biofuel conversion processes remains controversial, biofuels produced from cellulosic feedstocks hold great potential as a source of renewable, carbon neutral liquid fuel. Current conversion processes rely heavily on enzymatic conversion of cellulose to glucose for fermentation to ethanol or other fuels. Production of these enzymes from filamentous fungi, or purchase from another party, represents a major cost in the total conversion process. Efforts to reduce this cost have been a major focus of recent public and private research on biofuel production.

The greatest advances in cellulase production to date have been achieved by iterative, random mutagenesis of filamentous fungi. While this strategy has reduced the cost of enzyme production substantially, the resultant strains have hundreds of mutations. It is not clear which mutations have given rise to the desired increase in yield and which mutations are irrelevant or impair cellulase production. Without a fundamental understanding of how particular mutations improve cellulase yield, it will be difficult to further engineer industrial strains or transfer increased productivity to other strains of interest. A more systematic understanding of the biological process involved in cellulase production by filamentous fungi, and related compositions and methods, are needed.

BRIEF SUMMARY

In order to meet the above needs, the present disclosure provides novel methods and compositions for increasing the production of one or more cellulases from a fungal host cell. Moreover, the present disclosure is based, at least in part, on the surprising discovery that mis-expression of the transcriptional regulator clr-2 in a filamentous fungal cell was able to induce expression of cellulase genes under non-inducing or starvation conditions, resulting in increased secretion of cellulases from the cell. Advantageously, mis-expression of clr-2 in a filamentous fungal cell cultured in the absence of cellulose or cellobiose results in increased secretion of cellulases.

Accordingly, certain aspects of the present disclosure relate to a method of degrading cellulose-containing material, by: a) contacting cellulose-containing material with a fungal host cell containing at least one recombinant nucleic acid encoding a transcription factor protein, where the transcription factor protein contains a zinc(2)-cysteine(6) binuclear cluster domain, a PFAM04082 transcription factor domain, and at least one polypeptide sequence selected from SEQ ID NOs: 184, 185, 186, and 187; and b) incubating the fungal host cell and cellulose-containing material under conditions sufficient for the fungal host cell to degrade the cellulose-containing material. In certain embodiments, the transcription factor protein contains at least one additional polypeptide sequence selected from SEQ ID NOs: 184, 185, 186, and 187. In certain embodiments, the transcription factor protein contains at least two additional polypeptide sequences selected from SEQ ID NOs: 184, 185, 186, and 187. In certain embodiments, the transcription factor protein contains at least three additional polypeptide sequences selected from SEQ ID NOs: 184, 185, 186, and 187. In certain embodiments, the transcription factor protein contains SEQ ID NOs: 184, 185, 186, and 187.

Other aspects of the present disclosure relate to a method of degrading cellulose-containing material, by: a) contacting cellulose-containing material with a fungal host cell containing at least one recombinant nucleic acid encoding a transcription factor protein, where the transcription factor protein contains a zinc(2)-cysteine(6) binuclear cluster domain, a PFAM04082 transcription factor domain, and SEQ ID NO: 184; and b) incubating the fungal host cell and cellulose-containing material under conditions sufficient for the fungal host cell to degrade the cellulose-containing material. In certain embodiments, the transcription factor protein further contains SEQ ID NO: 185. In certain embodiments that may be combined with any of the preceding embodiments, the transcription factor further contains SEQ ID NO: 186. In certain embodiments that may be combined with any of the preceding embodiments, the transcription factor further contains SEQ ID NO: 185 and 186. In certain embodiments that may be combined with any of the preceding embodiments, the transcription factor further contains SEQ ID NO: 187. In certain embodiments that may be combined with any of the preceding embodiments, the transcription factor further contains SEQ ID NOs: 185 and 187. In certain embodiments that may be combined with any of the preceding embodiments, the transcription factor further contains SEQ ID NOs: 186 and 187. In certain embodiments that may be combined with any of the preceding embodiments, the transcription factor further contains SEQ ID NO: 185, 186, and 187.

Other aspects of the present disclosure relate to a method of degrading cellulose-containing material, by: a) contacting cellulose-containing material with a fungal host cell containing at least one recombinant nucleic acid encoding a transcription factor protein, where the transcription factor protein contains a zinc(2)-cysteine(6) binuclear cluster domain, a PFAM04082 transcription factor domain, and SEQ ID NOs: 184 and 185; and b) incubating the fungal host cell and cellulose-containing material under conditions sufficient for the fungal host cell to degrade the cellulose-containing material. In certain embodiments, the transcription factor protein further contains SEQ ID NO: 186. In certain embodiments that may be combined with any of the preceding embodiments, the transcription factor further contains SEQ ID NO: 187. In certain embodiments that may be combined with any of the preceding embodiments, the transcription factor further contains SEQ ID NO: 186 and 187.

Other aspects of the present disclosure relate to a method of degrading cellulose-containing material, by: a) contacting cellulose-containing material with a fungal host cell containing at least one recombinant nucleic acid encoding a transcription factor protein, where the transcription factor protein contains a zinc(2)-cysteine(6) binuclear cluster domain, a PFAM04082 transcription factor domain, and SEQ ID NOs: 184, 185, and 186; and b) incubating the fungal host cell and cellulose-containing material under conditions sufficient for the fungal host cell to degrade the cellulose-containing material. In certain embodiments, the transcription factor protein further contains SEQ ID NO: 187.

Other aspects of the present disclosure relate to a method of degrading cellulose-containing material, by: a) contacting cellulose-containing material with a fungal host cell containing at least one recombinant nucleic acid encoding a transcription factor protein, where the transcription factor protein contains a zinc(2)-cysteine(6) binuclear cluster domain, a PFAM04082 transcription factor domain, and SEQ ID NOs: 184, 185, 186, and 187; and b) incubating the fungal host cell and cellulose-containing material under conditions sufficient for the fungal host cell to degrade the cellulose-containing material.

In certain embodiments that may be combined with any of the preceding embodiments, the fungal host cell is incubated under conditions sufficient for the fungal host cell to express the transcription factor protein. In certain embodiments that may be combined with any of the preceding embodiments, the fungal host cell produces a greater amount of one or more cellulases than a corresponding fungal host cell lacking the at least one recombinant nucleic acid. In certain embodiments that may be combined with any of the preceding embodiments, the cellulose-containing material contains biomass. In certain embodiments, the biomass is subjected to pretreatment prior to being contacted with the fungal host cell. In certain embodiments, the pretreatment contains one or more treatments selected from ammonia fiber expansion (AFEX), steam explosion, treatment with high temperature, treatment with high pressure, treatment with alkaline aqueous solutions, treatment with acidic solutions, treatment with organic solvents, treatment with ionic liquids (IL), treatment with electrolyzed water, and treatment with phosphoric acid. In certain embodiments that may be combined with any of the preceding embodiments, the biomass contains a plant material. In certain embodiments, the plant material is selected from *Miscanthus*, switchgrass, cord grass, rye grass, reed canary grass, elephant grass, common reed, wheat straw, barley straw, canola straw, oat straw, corn stover, soybean stover, oat hulls, sorghum, rice hulls, sugarcane bagasse, corn fiber, Distillers Dried Grains with Solubles (DDGS), Blue Stem, corncobs, pine wood, birch wood, willow wood, aspen wood, poplar wood, and energy cane. In certain embodiments that may be combined with any of the preceding embodiments, the fungal host cell further contains one or more recombinant nucleic acids that encode a polypeptide involved in a biochemical pathway for the production of at least one biofuel. In certain embodiments, the method further includes incubating the fungal host cell with the degraded cellulose-containing material under conditions sufficient for the fungal host cell to convert the cellulose-containing material to at least one biofuel. In certain embodiments that may be combined with any of the preceding embodiments, the biofuel is selected from ethanol, n-propanol, n-butanol, iso-butanol, 3-methyl-butanol, 2-methyl-1-butanol, 3-methyl-1-pentanol, and octanol. In certain embodiments that may be combined with any of the preceding embodiments, the degraded cellulose-containing material is cultured with a fermentative microorganism under conditions sufficient to produce at least one fermentation product from the degraded cellulose-containing material.

Other aspects of the present disclosure relate to a method of increasing the production of one or more cellulases from a fungal cell, by: (a) providing a fungal host cell containing at least one recombinant nucleic acid encoding a transcription factor protein, where the transcription factor protein contains a zinc(2)-cysteine(6) binuclear cluster domain, a PFAM04082 transcription factor domain, and at least one polypeptide sequence selected from SEQ ID NOs: 184, 185, 186, and 187; and (b) culturing the host cell under conditions sufficient to support the expression of the at least one recombinant nucleic acid, where the fungal host cell produces a greater amount of the one or more cellulases than a corresponding host cell lacking the at least one recombinant nucleic acid. In certain embodiments, the transcription factor protein contains at least one additional polypeptide sequence selected from SEQ ID NOs: 184, 185, 186, and 187. In certain embodiments, the transcription factor protein contains at least two additional polypeptide sequences selected from SEQ ID NOs: 184, 185, 186, and 187. In certain embodiments, the transcription factor protein contains at least three additional polypeptide sequences selected from SEQ ID NOs: 184, 185, 186, and 187. In certain embodiments, the transcription factor protein contains SEQ ID NOs: 184, 185, 186, and 187. In certain embodiments, the fungal host cell is cultured in the absence of cellulose.

Other aspects of the present disclosure relate to a method of increasing the production of one or more cellulases from a fungal cell, by: (a) providing a fungal host cell containing at least one recombinant nucleic acid encoding a transcription factor protein, where the transcription factor protein contains a zinc(2)-cysteine(6) binuclear cluster domain, a PFAM04082 transcription factor domain, and SEQ ID NO: 184; and (b) culturing the host cell under conditions sufficient to support the expression of the at least one recombinant nucleic acid, where the fungal host cell produces a greater amount of the one or more cellulases than a corresponding host cell lacking the at least one recombinant nucleic acid. In certain embodiments, the transcription factor protein further contains SEQ ID NO: 185. In certain embodiments that may be combined with any of the preceding embodiments, the transcription factor further contains SEQ ID NO: 186. In certain embodiments that may be combined with any of the preceding embodiments, the transcription factor further contains SEQ ID NO: 185 and 186. In certain embodiments that may be combined with any of the preceding embodiments, the transcription factor further contains SEQ ID NO: 187. In certain embodiments that may be combined with any of the preceding embodiments, the transcription factor further contains SEQ ID NOs: 185 and 187. In certain embodiments that may be combined with any of the preceding embodiments, the transcription factor further contains SEQ ID NOs: 186 and 187. In certain embodiments that may be combined with any of the preceding embodiments, the transcription factor further contains SEQ ID NO: 185, 186, and 187. In certain embodiments, the fungal host cell is cultured in the absence of cellulose.

Other aspects of the present disclosure relate to a method of increasing the production of one or more cellulases from a fungal cell, by: (a) providing a fungal host cell containing at least one recombinant nucleic acid encoding a transcription factor protein, where the transcription factor protein contains a zinc(2)-cysteine(6) binuclear cluster domain, a PFAM04082 transcription factor domain, and SEQ ID NOs: 184 and 185; and (b) culturing the host cell under conditions sufficient to support the expression of the at least one recombinant nucleic acid, where the fungal host cell produces a greater amount of the one or more cellulases than a corresponding host cell lacking the at least one recombinant nucleic acid. In certain embodiments, the transcription factor protein further contains SEQ ID NO: 186. In certain embodiments that may be combined with any of the preceding embodiments, the transcription factor further contains SEQ ID NO: 187. In certain embodiments that may be combined with any of the preceding embodiments, the transcription factor further contains SEQ ID NO: 186 and 187. In certain embodiments, the fungal host cell is cultured in the absence of cellulose.

Other aspects of the present disclosure relate to a method of increasing the production of one or more cellulases from a fungal cell, by: (a) providing a fungal host cell containing at least one recombinant nucleic acid encoding a transcription factor protein, where the transcription factor protein contains a zinc(2)-cysteine(6) binuclear cluster domain, a PFAM04082 transcription factor domain, and SEQ ID NOs: 184, 185, and 186; and (b) culturing the host cell under conditions sufficient to support the expression of the at least one recombinant nucleic acid, where the fungal host cell produces a greater amount of the one or more cellulases than a corresponding host cell lacking the at least one recombinant nucleic acid. In certain embodiments, the transcription factor protein further contains SEQ ID NO: 187. In certain embodiments, the fungal host cell is cultured in the absence of cellulose.

Other aspects of the present disclosure relate to a method of increasing the production of one or more cellulases from a fungal cell, by: (a) providing a fungal host cell containing at least one recombinant nucleic acid encoding a transcription factor protein, where the transcription factor protein contains a zinc(2)-cysteine(6) binuclear cluster domain, a PFAM04082 transcription factor domain, and SEQ ID NOs: 184, 185, 186, and 187; and (b) culturing the host cell under conditions sufficient to support the expression of the at least one recombinant nucleic acid, where the fungal host cell produces a greater amount of the one or more cellulases than a corresponding host cell lacking the at least one recombinant nucleic acid. In certain embodiments, the fungal host cell is cultured in the absence of cellulose.

In certain embodiments that may be combined with any of the preceding embodiments, the at least one recombinant nucleic acid encodes a clr-2 transcription factor protein. In certain embodiments that may be combined with any of the preceding embodiments, the at least one recombinant nucleic acid is SEQ ID NO: 5 or SEQ ID NO: 165. In certain embodiments that may be combined with any of the preceding embodiments, the at least one recombinant nucleic acid is operatively linked to a promoter selected from ccg-1, gpd-1, vvd, qa-2, pdA, trpC, tef-1, and xlr-1.

In certain embodiments that may be combined with any of the preceding embodiments, the fungal host cell further contains at least one additional recombinant nucleic acid encoding an additional transcription factor protein, where the additional transcription factor protein contains a zinc(2)-cysteine(6) binuclear cluster domain, a PFAM04082 transcription factor domain, and at least one polypeptide sequence selected from SEQ ID NOs: 188, 189, 190, 191, and 192. In certain embodiments, the additional transcription factor protein contains at least one additional polypeptide sequence selected from SEQ ID NOs: 188, 189, 190, 191, and 192. In certain embodiments, the additional transcription factor protein contains at least two additional polypeptide sequences selected from SEQ ID NOs: 188, 189, 190, 191, and 192. In certain embodiments, the additional transcription factor protein contains at least three additional polypeptide sequences selected from SEQ ID NOs: 188, 189, 190, 191, and 192. In certain embodiments, the additional transcription factor protein contains at least four additional polypeptide sequences selected from SEQ ID NOs: 188, 189, 190, 191, and 192. In certain embodiments, the additional transcription factor protein contains SEQ ID NOs: 188, 189, 190, 191, and 192. In certain embodiments that may be combined with any of the preceding embodiments, the fungal host cell further contains at least one additional recombinant nucleic acid encoding an additional transcription factor protein, where the additional transcription factor protein contains a zinc(2)-cysteine(6) binuclear cluster domain, a PFAM04082 transcription factor domain, and SEQ ID NO: 188. In certain embodiments, the additional transcription factor protein further contains SEQ ID NO: 189. In certain embodiments that may be combined with any of the preceding embodiments, the additional transcription factor further contains SEQ ID NO: 190. In certain embodiments that may be combined with any of the preceding embodiments, the additional transcription factor further contains SEQ ID NO: 189 and 190. In certain embodiments that may be combined with any of the preceding embodiments, the additional transcription factor further contains SEQ ID NO: 191. In certain embodiments that may be combined with any of the preceding embodiments, the additional transcription factor further contains SEQ ID NOs: 189 and 191. In certain embodiments that may be combined with any of the preceding embodiments, the additional transcription factor further contains SEQ ID NOs: 190 and 191. In certain embodiments that may be combined with any of the preceding embodiments, the additional transcription factor further contains SEQ ID NO: 192. In certain embodiments that may be combined with any of the preceding embodiments, the additional transcription factor further contains SEQ ID NOs: 189 and 192. In certain embodiments that may be combined with any of the preceding embodiments, the additional transcription factor further contains SEQ ID NOs: 190 and 192. In certain embodiments that may be combined with any of the preceding embodiments, the additional transcription factor further contains SEQ ID NOs: 191 and 192. In certain embodiments that may be combined with any of the preceding embodiments, the additional transcription factor further contains SEQ ID NO: 189, 190, 191, and 192. In certain embodiments that may be combined with any of the preceding embodiments, the at least one additional recombinant nucleic acid encodes a clr-1 transcription factor protein. In certain embodiments that may be combined with any of the preceding embodiments, the at least one additional recombinant nucleic acid encoding the additional transcription factor is SEQ ID NO: 2, SEQ ID NO: 119, or SEQ ID NO: 183. In certain embodiments that may be combined with any of the preceding embodiments, the at least one additional recombinant nucleic acid is operatively linked to a promoter selected from ccg-1, gpd-1, vvd, qa-2, pdA, trpC, tef-1, and xlr-1.

In certain embodiments that may be combined with any of the preceding embodiments, the fungal host cell further contains at least one recombinant nucleic acid encoding a hemicellulase. In certain embodiments that may be combined with any of the preceding embodiments, the fungal host cell is selected from Neurospora crassa, Metarhizium anisopliae, Gibberella zeae, Nectria haematococca, Magnaporthe oryzae, Neurospora tetrasperma, Sordaria macrospora, Chaetomium globosum, Podospora anserina, Verticillium albo-atrum, Glomerella graminicola, Grosmannia clavigera, Sclerotinia sclerotiorum, Botryotinia fuckeliana, Aspergillus oryzae, Aspergillus nidulans, Aspergillus niger, Aspergillus fumigatus, Penicillium chrysogenum, Leptosphaeria maculans, Phaeosphaeria nodorum, Pyrenophora tritici-repentis, Pyrenophora teres, Penicillium marneffei, Talaromyces stipitatus, Trichoderma reesei, Uncinocarpus reesii, Coccidioides immitus, Coccidioides posadasii, Saccharomyces cerevisiae, Schizosaccharomyces pombe, Sporotrichum thermophile (Myceliophthora thermophila), Thielavia terrestris-thermophilic, Acremonium cellulolyticus, Yarrowia lipolytica, Hansenula polymorpha, Kluyveromyces lactis, Pichia pastoris, Mycosphaerella graminicola, Neosartorya fischeri, Thermomyces lanuginosus (Humicola brevis, Humicola brevispora, Humicola grisea, Humicola lanuginosa, Monotospora lanuginosa, Sepedonium lanuginosum), Talaromyces thermophilus (Talaromyces dupontii, Penicillium dupontii), and Chrysosporium lucknowense.

Other aspects of the present disclosure relate to a method of reducing the viscosity of a pretreated biomass material, by contacting pretreated biomass material with a fungal host cell containing at least one recombinant nucleic acid encoding a transcription factor protein, to yield a pretreated biomass material having reduced viscosity, where the transcription factor protein contains a zinc(2)-cysteine(6) binuclear cluster domain, a PFAM04082 transcription factor domain, and at least one polypeptide sequence selected from SEQ ID NOs: 184, 185, 186, and 187. In certain embodiments, the transcription factor protein contains at least one additional polypeptide sequence selected from SEQ ID NOs: 184, 185, 186, and 187. In certain embodiments, the transcription factor protein contains at least two additional polypeptide sequences selected from SEQ ID NOs: 184, 185, 186, and 187. In certain embodiments, the transcription factor protein contains at least three additional polypeptide sequences selected from SEQ ID NOs: 184, 185, 186, and 187. In certain embodiments, the transcription factor protein contains SEQ ID NOs: 184, 185, 186, and 187. In certain embodiments, the at least one additional recombinant nucleic acid encodes a clr-2 transcription factor protein. In certain embodiments, the at least one recombinant nucleic acid is SEQ ID NO: 5 or SEQ ID NO: 165. In certain embodiments that may be combined with any of the preceding embodiments, the fungal host cell further contains at least one additional recombinant nucleic acid encoding an additional transcription factor, where the additional transcription factor protein contains a zinc(2)-cysteine(6) binuclear cluster domain, a PFAM04082 transcription factor domain, and at least one, at least two, at least three, at least four, or at least five polypeptide sequences selected from SEQ ID NOs: 188, 189, 190, 191, and 192. In certain embodiments, the at least one additional recombinant nucleic acid encodes a clr-1 transcription factor protein. In certain embodiments, the at least one additional recombinant nucleic acid encoding the additional transcription factor protein is SEQ ID NO: 2, SEQ ID NO: 119, or SEQ ID NO: 183.

Other aspects of the present disclosure relate to a method of reducing the viscosity of a pretreated biomass material, by contacting pretreated biomass material with a fungal host cell containing at least one recombinant nucleic acid encoding a transcription factor protein, to yield a pretreated biomass material having reduced viscosity, where the transcription factor protein contains a zinc(2)-cysteine(6) binuclear cluster domain, a PFAM04082 transcription factor domain, and SEQ ID NO: 184. In certain embodiments, the transcription factor protein further contains SEQ ID NO: 185. In certain embodiments that may be combined with any of the preceding embodiments, the transcription factor further contains SEQ ID NO: 186. In certain embodiments that may be combined with any of the preceding embodiments, the transcription factor further contains SEQ ID NO: 185 and 186. In certain embodiments that may be combined with any of the preceding embodiments, the transcription factor further contains SEQ ID NO: 187. In certain embodiments that may be combined with any of the preceding embodiments, the transcription factor further contains SEQ ID NOs: 185 and 187. In certain embodiments that may be combined with any of the preceding embodiments, the transcription factor further contains SEQ ID NOs: 186 and 187. In certain embodiments that may be combined with any of the preceding embodiments, the transcription factor further contains SEQ ID NO: 185, 186, and 187. In certain embodiments, the at least one additional recombinant nucleic acid encodes a clr-2 transcription factor protein. In certain embodiments, the at least one recombinant nucleic acid is SEQ ID NO: 5 or SEQ ID NO: 165. In certain embodiments that may be combined with any of the preceding embodiments, the fungal host cell further contains at least one additional recombinant nucleic acid encoding an additional transcription factor, where the additional transcription factor protein contains a zinc(2)-cysteine(6) binuclear cluster domain, a PFAM04082 transcription factor domain, and at least one, at least two, at least three, at least four, or at least five polypeptide sequences selected from SEQ ID NOs: 188, 189, 190, 191, and 192. In certain embodiments, the at least one additional recombinant nucleic acid encodes a clr-1 transcription factor protein. In certain embodiments, the at least one additional recombinant nucleic acid encoding the additional transcription factor protein is SEQ ID NO: 2, SEQ ID NO: 119, or SEQ ID NO: 183.

Other aspects of the present disclosure relate to a method of reducing the viscosity of a pretreated biomass material, by contacting pretreated biomass material with a fungal host cell containing at least one recombinant nucleic acid encoding a transcription factor protein, to yield a pretreated biomass material having reduced viscosity, where the transcription factor protein contains a zinc(2)-cysteine(6) binuclear cluster domain, a PFAM04082 transcription factor domain, and SEQ ID NOs: 184 and 185. In certain embodiments, the transcription factor protein further contains SEQ ID NO: 186. In certain embodiments that may be combined with any of the preceding embodiments, the transcription factor further contains SEQ ID NO: 187. In certain embodiments that may be combined with any of the preceding embodiments, the transcription factor further contains SEQ ID NO: 186 and 187. In certain embodiments, the at least one additional recombinant nucleic acid encodes a clr-2 transcription factor protein. In certain embodiments, the at least one recombinant nucleic acid is SEQ ID NO: 5 or SEQ ID NO: 165. In certain embodiments that may be combined with any of the preceding embodiments, the fungal host cell further contains at least one additional recombinant nucleic acid encoding an additional transcription factor, where the additional transcription factor protein contains a zinc(2)-cysteine(6) binuclear cluster domain, a PFAM04082 transcription factor domain, and at least one, at least two, at least three, at least four, or at least five polypeptide sequences selected from SEQ ID NOs: 188, 189, 190, 191, and 192. In certain embodiments, the at least one additional recombinant nucleic acid encodes a clr-1 transcription factor protein. In certain embodiments, the at least one additional recombinant nucleic acid encoding the additional transcription factor protein is SEQ ID NO: 2, SEQ ID NO: 119, or SEQ ID NO: 183.

Other aspects of the present disclosure relate to a method of reducing the viscosity of a pretreated biomass material, by contacting pretreated biomass material with a fungal host cell containing at least one recombinant nucleic acid encoding a transcription factor protein, to yield a pretreated biomass material having reduced viscosity, where the transcription factor protein contains a zinc(2)-cysteine(6) binuclear cluster domain, a PFAM04082 transcription factor domain, and SEQ ID NOs: 184, 185, and 186. In certain embodiments, the transcription factor protein further contains SEQ ID NO: 187. In certain embodiments, the at least one additional recombinant nucleic acid encodes a clr-2 transcription factor protein. In certain embodiments, the at least one recombinant nucleic acid is SEQ ID NO: 5 or SEQ ID NO: 165. In certain embodiments that may be combined with any of the preceding embodiments, the fungal host cell further contains at least one additional recombinant nucleic acid encoding an additional transcription factor, where the additional transcription factor protein contains a zinc(2)-cysteine(6) binuclear cluster domain, a PFAM04082 transcription factor domain, and at least one, at least two, at least three, at least four, or at least five polypeptide sequences selected from SEQ ID NOs: 188, 189, 190, 191, and 192. In certain embodiments, the at least one additional recombinant nucleic acid encodes a clr-1 transcription factor protein. In certain embodiments, the at least one additional recombinant nucleic acid encoding the additional transcription factor protein is SEQ ID NO: 2, SEQ ID NO: 119, or SEQ ID NO: 183.

In some embodiments, provided herein is a fungal host cell containing at least one recombinant nucleic acid encoding a clr-2 transcription factor protein.

Also provided herein is a fungal host cell containing at least one recombinant nucleic acid encoding a clr-2 transcription factor protein, where the recombinant nucleic acid is SEQ ID NO: 5 or SEQ ID NO: 165.

Also provided herein is a fungal host cell containing at least one recombinant nucleic acid encoding a clr-2 transcription factor protein, where the cell further contains at least one additional recombinant nucleic acid encoding a clr-1 transcription factor protein.

Also provided herein is a fungal host cell containing at least one recombinant nucleic acid encoding a clr-2 transcription factor protein and at least one additional recombinant nucleic acid encoding a clr-1 transcription factor protein, and where the recombinant nucleic acid encoding a clr-1 protein is SEQ ID NO: 2, SEQ ID NO: 119, or SEQ ID NO: 183.

Further provided herein is a fungal host cell containing at least one recombinant nucleic acid encoding a clr-2 transcription factor protein and at least one additional recombinant nucleic acid encoding a clr-1 transcription factor protein, where the recombinant nucleic acid encoding a clr-2 protein is SEQ ID NO: 5 or SEQ ID NO: 165, and the recombinant nucleic acid encoding a clr-1 protein is SEQ ID NO: 2, SEQ ID NO: 119, or SEQ ID NO: 183.

Also provided herein is a fungal host cell containing at least one recombinant nucleic acid encoding a clr-2 transcription factor protein, where the cell further contains one or more additional recombinant nucleic acids encoding a hemicellulase.

Also provided herein is a fungal host cell containing at least one recombinant nucleic acid encoding a clr-2 transcription factor protein and at least one additional recombinant nucleic acid encoding a clr-1 transcription factor protein, where the cell further contains one or more recombinant nucleic acids encoding a hemicellulase.

Also provided herein is a fungal host cell containing at least one recombinant nucleic acid encoding a clr-2 transcription factor protein, where the host cell is selected from *Neurospora crassa, Metarhizium anisopliae, Gibberella zeae, Nectria haematococca, Magnaporthe oryzae, Neurospora tetrasperma, Sordaria macrospora, Chaetomium globosum, Podospora anserina, Verticillium albo-atrum, Glomerella graminicola, Grosmannia clavigera, Sclerotinia sclerotiorum, Botryotinia fuckeliana, Aspergillus oryzae, Aspergillus nidulans, Aspergillus niger, Aspergillus fumigatus, Penicillium chrysogenum, Leptosphaeria maculans, Phaeosphaeria nodorum, Pyrenophora tritici-repentis, Pyrenophora teres, Penicillium marneffei, Talaromyces stipitatus, Trichoderma reesei, Uncinocarpus reesii, Coccidioides immitis, Coccidioides posadasii, Saccharomyces cerevisiae, Schizosaccharomyces pombe, Sporotrichum thermophile (Myceliophthora thermophila), Thielavia terrestris-thermophilic, Acremonium cellulolyticus, Yarrowia lipolytica, Hansenula polymorpha, Kluyveromyces lactis, Pichia pastoris, Mycosphaerella graminicola, Neosartoryafischeri, Thermomyces lanuginosus (Humicola brevis, Humicola brevispora, Humicola grisea, Humicola lanuginosa, Monotospora lanuginosa, Sepedonium lanuginosum), Talaromyces thermophilus (Talaromyces dupontii, Penicillium dupontii)*, or *Chrysosporium lucknowense*.

Also provided herein is a fungal host cell containing at least one recombinant nucleic acid encoding a clr-2 transcription factor protein and at least one additional recombinant nucleic acid encoding a clr-1 transcription factor protein, where the host cell is selected from *Neurospora crassa, Metarhizium anisopliae, Gibberella zeae, Nectria haematococca, Magnaporthe oryzae, Neurospora tetrasperma, Sordaria macrospora, Chaetomium globosum, Podospora anserina, Verticillium albo-atrum, Glomerella graminicola, Grosmannia clavigera, Sclerotinia sclerotiorum, Botryotinia fuckeliana, Aspergillus oryzae, Aspergillus nidulans, Aspergillus niger, Aspergillusfumigatus, Penicillium chrysogenum, Leptosphaeria maculans, Phaeosphaeria nodorum, Pyrenophora tritici-repentis, Pyrenophora teres, Penicillium marneffei, Talaromyces stipitatus, Trichoderma reesei, Uncinocarpus reesii, Coccidioides immitis, Coccidioides posadasii, Saccharomyces cerevisiae, Schizosaccharomyces pombe, Sporotrichum thermophile (Myceliophthora thermophila), Thielavia terrestris-thermophilic, Acremonium cellulolyticus, Yarrowia lipolytica, Hansenula polymorpha, Kluyveromyces lactis, Pichia pastoris, Mycosphaerella graminicola, Neosartorya fischeri, Thermomyces lanuginosus (Humicola brevis, Humicola brevispora, Humicola grisea, Humicola lanuginosa, Monotospora lanuginosa, Sepedonium lanuginosum), Talaromyces thermophilus (Talaromyces dupontii, Penicillium dupontii)*, or *Chrysosporium lucknowense*.

In some embodiments, provided herein is a method of increasing the growth of a fungal cell, the method including incubating a fungal host cell containing at least one recombinant nucleic acid encoding a clr-2 transcription factor protein in media under conditions sufficient to support the expression of said recombinant nucleic acid, where the host cell grows at a faster rate than a corresponding host cell lacking said recombinant nucleic acid.

In some embodiments, provided herein is a method of increasing the growth of a fungal cell, the method including incubating a fungal host cell containing at least one recombinant nucleic acid encoding a clr-2 transcription factor protein and at least one additional recombinant nucleic acid encoding a clr-1 transcription factor protein in media under conditions sufficient to support the expression of the recombinant nucleic acids, where the host cell grows at a faster rate than a corresponding host cell lacking said recombinant nucleic acids.

In some embodiments, provided herein is a method of increasing the production of cellulases from a fungal cell, the method including incubating a fungal host cell containing at least one recombinant nucleic acid encoding a clr-2 transcription factor protein in growth media under conditions sufficient to support the expression of said recombinant nucleic acid, where the host cell produces a greater amount of cellulases than a corresponding host cell lacking said recombinant nucleic acid.

In some embodiments, provided herein is method of increasing the production of cellulases from a fungal cell, the method including incubating a fungal host cell containing at least one recombinant nucleic acid encoding a clr-2 transcription factor protein and at least one additional recombinant nucleic acid encoding a clr-1 transcription factor protein in growth media under conditions sufficient to support the expression of the recombinant nucleic acids, where the host cell produces a greater amount of cellulases than a corresponding host cell lacking said recombinant nucleic acids.

Also provided herein is a method of increasing the production of cellulases from a fungal cell, the method including incubating a fungal host cell containing at least one recombinant nucleic acid encoding a clr-2 transcription factor protein in growth media that does not contain cellulose under conditions sufficient to support the expression of said recombinant nucleic acid, where the host cell produces a greater amount of cellulases than a corresponding host cell lacking said recombinant nucleic acid.

Also provided herein is a method of increasing the production of cellulases from a fungal cell, the method including incubating a fungal host cell containing at least one recombinant nucleic acid encoding a clr-2 transcription factor protein and at least one additional recombinant nucleic acid encoding a clr-1 transcription factor protein in growth media that does not contain cellulose under conditions sufficient to support the expression of said recombinant nucleic acids, where the host cell produces a greater amount of cellulases than a corresponding host cell lacking said recombinant nucleic acids.

In some embodiments, provided herein is a method of preparing one or more cellulases, the method including: a) incubating a fungal host cell containing at least one recombinant nucleic acid encoding a clr-2 transcription factor protein in media under conditions sufficient to support the expression of said recombinant nucleic acid, and b) collecting one or more cellulases from said media and/or said fungal host cell.

In some embodiments, provided herein is a method of preparing one or more cellulases, the method including: a) incubating a fungal host cell containing at least one recombinant nucleic acid encoding a clr-2 transcription factor protein and at least one additional recombinant nucleic acid encoding a clr-1 transcription factor protein in media under conditions sufficient to support the expression of said recombinant nucleic acids, and b) collecting one or more cellulases from said media and/or said fungal host cell.

Further provided herein is a method of degrading a cellulose-containing material, the method including: a) contacting the cellulose-containing material with a fungal host cell containing at least one recombinant nucleic acid encoding a clr-2 transcription factor protein, and b) incubating the fungal host cell and cellulose-containing material under conditions that support cellulose degradation.

Also provided herein is a method of degrading a cellulose-containing material, the method including: a) contacting the cellulose-containing material with a fungal host cell containing at least one recombinant nucleic acid encoding a clr-2 transcription factor protein and at least one additional recombinant nucleic acid encoding a clr-1 transcription factor protein, and b) incubating the fungal host cell and cellulose-containing material under conditions that support cellulose degradation.

Further provided herein is a method of converting a cellulose-containing material to fermentation product, the method including: a) contacting the cellulose-containing material with a fungal host cell containing at least one recombinant nucleic acid encoding a clr-2 transcription factor protein, to yield a sugar solution, and b) culturing the sugar solution with a fermentative microorganism under conditions sufficient to produce a fermentation product.

Also provided herein is a method of converting a cellulose-containing material to fermentation product, the method including: a) contacting the cellulose-containing material with a fungal host cell containing at least one recombinant nucleic acid encoding a clr-2 transcription factor protein and at least one additional recombinant nucleic acid encoding a clr-1 transcription factor protein, to yield a sugar solution, and b) culturing the sugar solution with a fermentative microorganism under conditions sufficient to produce a fermentation product.

Also provided herein is a method of converting biomass to fermentation product, the method including: a) contacting the biomass with a fungal host cell containing at least one recombinant nucleic acid encoding a clr-2 transcription factor protein, to yield a sugar solution, and b) culturing the sugar solution with a fermentative microorganism under conditions sufficient to produce a fermentation product.

Also provided herein is a method of converting biomass to fermentation product, the method including: a) contacting the biomass with a fungal host cell containing at least one recombinant nucleic acid encoding a clr-2 transcription factor protein and at least one additional recombinant nucleic acid encoding a clr-1 transcription factor protein, to yield a sugar solution, and b) culturing the sugar solution with a fermentative microorganism under conditions sufficient to produce a fermentation product.

Also provided herein is a method of converting biomass to fermentation product, the method including: a) pretreating the biomass, b) contacting the biomass with a fungal host cell containing at least one recombinant nucleic acid encoding a clr-2 transcription factor protein, to yield a sugar solution, and c) culturing the sugar solution with a fermentative microorganism under conditions sufficient to produce a fermentation product.

Also provided herein is a method of converting biomass to fermentation product, the method including: a) pretreating the biomass, b) contacting the biomass with a fungal host cell containing at least one recombinant nucleic acid encoding a clr-2 transcription factor protein and at least one additional recombinant nucleic acid encoding a clr-1 transcription factor protein, to yield a sugar solution, and c) culturing the sugar solution with a fermentative microorganism under conditions sufficient to produce a fermentation product.

Also provided herein is a method of converting biomass to fermentation product, the method including: a) pretreating the biomass by a method that includes one or more of ammonia fiber expansion (AFEX), steam explosion, treatment with high temperature, treatment with high pressure, treatment with alkaline aqueous solutions, treatment with acidic solutions, treatment with organic solvents, treatment with ionic liquids (IL), treatment with electrolyzed water, and treatment with phosphoric acid, b) contacting the biomass with a fungal host cell containing at least one recombinant nucleic acid encoding a clr-2 transcription factor protein, to yield a sugar solution, and c) culturing the sugar solution with a fermentative microorganism under conditions sufficient to produce a fermentation product.

Also provided herein is a method of converting biomass to fermentation product, the method including: a) pretreating the biomass by a method that includes one or more of ammonia fiber expansion (AFEX), steam explosion, treatment with high temperature, treatment with high pressure, treatment with alkaline aqueous solutions, treatment with acidic solutions, treatment with organic solvents, treatment with ionic liquids (IL), treatment with electrolyzed water, and treatment with phosphoric acid, b) contacting the biomass with a fungal host cell containing at least one recombinant nucleic acid encoding a clr-2 transcription factor protein and at least one additional recombinant nucleic acid encoding a clr-1 transcription factor protein, to yield a sugar solution, and c) culturing the sugar solution with a fermentative microorganism under conditions sufficient to produce a fermentation product.

Additionally provided herein is a method of converting a plant material to fermentation product, the method including: a) contacting the biomass with a fungal host cell containing at least one recombinant nucleic acid encoding a clr-2 transcription factor protein, to yield a sugar solution, and b) culturing the sugar solution with a fermentative microorganism under conditions sufficient to produce a fermentation product.

Additionally provided herein is a method of converting a plant material to fermentation product, the method including: a) contacting the biomass with a fungal host cell containing at least one recombinant nucleic acid encoding a clr-2 transcription factor protein and at least one additional recombinant nucleic acid encoding a clr-1 transcription factor protein, to yield a sugar solution, and b) culturing the sugar solution with a fermentative microorganism under conditions sufficient to produce a fermentation product.

Also provided herein is a method of converting a plant material selected from *Miscanthus*, switchgrass, cord grass, rye grass, reed canary grass, elephant grass, common reed, wheat straw, barley straw, canola straw, oat straw, corn stover, soybean stover, oat hulls, sorghum, rice hulls, sugarcane bagasse, corn fiber, Distillers Dried Grains with Solubles (DDGS), Blue Stem, corncobs, pine wood, birch wood, willow wood, aspen wood, poplar wood, and energy cane to fermentation product, the method including: a) contacting the biomass with a fungal host cell containing at least one recombinant nucleic acid encoding a clr-2 transcription factor protein, to yield a sugar solution, and b) culturing the sugar solution with a fermentative microorganism under conditions sufficient to produce a fermentation product.

Also provided herein is a method of converting a plant material selected from *Miscanthus*, switchgrass, cord grass, rye grass, reed canary grass, elephant grass, common reed, wheat straw, barley straw, canola straw, oat straw, corn stover, soybean stover, oat hulls, sorghum, rice hulls, sugarcane bagasse, corn fiber, Distillers Dried Grains with Solubles (DDGS), Blue Stem, corncobs, pine wood, birch wood, willow wood, aspen wood, poplar wood, and energy cane to fermentation product, the method including: a) contacting the biomass with a fungal host cell containing at least one recombinant nucleic acid encoding a clr-2 transcription factor protein and at least one additional recombinant nucleic acid encoding a clr-1 transcription factor protein, to yield a sugar solution, and b) culturing the sugar solution with a fermentative microorganism under conditions sufficient to produce a fermentation product.

Further provided herein is a method of reducing the viscosity of a pretreated biomass material, the method including contacting the pretreated biomass material with a fungal host cell containing at least one recombinant nucleic acid encoding a clr-2 transcription factor protein, to yield a pretreated biomass material having reduced viscosity.

Further provided herein is a method of reducing the viscosity of a pretreated biomass material, the method including contacting the pretreated biomass material with a fungal host cell containing at least one recombinant nucleic acid encoding a clr-2 transcription factor protein and at least one additional recombinant nucleic acid encoding a clr-1 transcription factor protein, to yield a pretreated biomass material having reduced viscosity.

In some embodiments, provided herein is a non-naturally occurring fungal cell, where the cell naturally contains genes encoding clr-1 and clr-2 proteins, and where the cell contains modifications causing reduced expression of the clr-1 and clr-2 proteins, as compared to the expression of the clr-1 and clr-2 proteins in a corresponding fungal cell lacking said modifications.

Also provided herein is a non-naturally occurring fungal cell, where the cell naturally contains genes encoding clr-1 and clr-2 proteins, and where the cell contains modifications causing reduced expression of the clr-1 and clr-2 proteins, as compared to the expression of the clr-1 and clr-2 proteins in a corresponding fungal cell lacking said modifications, and where the modifications are caused by RNAi, antisense RNA, T-DNA insertion, transposon insertion, insertional mutagenesis, site-directed mutagenesis, partial deletion of the gene, or complete deletion of the gene.

Also provided herein is a non-naturally occurring *Neurospora* cell, where the cell naturally contains genes encoding clr-1 and clr-2 proteins, and where the cell contains modifications causing reduced expression of the clr-1 and clr-2 proteins, as compared to the expression of the clr-1 and clr-2 proteins in a corresponding fungal cell lacking said modifications.

Also provided herein is a non-naturally occurring fungal cell, where the cell naturally contains genes encoding clr-1 and clr-2 proteins, and where the cell contains modifications causing reduced expression of the clr-1 and clr-2 proteins, as compared to the expression of the clr-1 and clr-2 proteins in a corresponding fungal cell lacking said modifications, and where the cell further contains a recombinant nucleic acid encoding a polypeptide involved in cellulose metabolism.

Also provided herein is a non-naturally occurring fungal cell, where the cell naturally contains genes encoding clr-1 and clr-2 proteins, and where the cell contains modifications causing reduced expression of the clr-1 and clr-2 proteins, as compared to the expression of the clr-1 and clr-2 proteins in a corresponding fungal cell lacking said modifications, and where the cell further contains a recombinant nucleic acid encoding a cellulase.

In some embodiments, provided herein is a non-*Neurospora* cell, containing DNA encoding one or more cellulase polypeptides and at least one gene orthologous to the *Neurospora crassa* gene SEQ ID NO: 5, where the cell contains at least one modification causing reduced expression of at least one of said gene(s) orthologous to the *Neurospora crassa* gene SEQ ID NO: 5, as compared with a corresponding cell lacking said modification, and, where the reduced expression of at least one of said gene(s) orthologous to the *Neurospora crassa* gene SEQ ID NO: 5 causes reduced expression of one or more of said cellulase polypeptides, as compared with expression of said cellulase polypeptides in a corresponding cell lacking said modification.

In some embodiments, provided herein is a non-*Neurospora* cell, containing DNA encoding one or more cellulase polypeptides, at least one gene orthologous to the *Neurospora crassa* gene SEQ ID NO: 5, and at least one gene orthologous to the *Neurospora crassa* gene SEQ ID NO: 2, where the cell contains at least one modification causing reduced expression of at least one of said gene(s) orthologous to the *Neurospora crassa* gene SEQ ID NO: 5 and at least one modification causing reduced expression of one of said gene(s) orthologous to the *Neurospora crassa* gene SEQ ID NO: 2, as compared with a corresponding cell lacking said modifications, and, where the reduced expression of at least one of said gene(s) orthologous to the *Neurospora crassa* gene SEQ ID NO: 5 and at least one of said gene(s) orthologous to the *Neurospora crassa* gene SEQ ID NO: 2 causes reduced expression of one or more of said cellulase polypeptides, as compared with expression of said cellulase polypeptides in a corresponding cell lacking said modifications.

Also provided herein is a non-*Neurospora* cell, containing DNA encoding one or more cellulase polypeptides and at least one gene orthologous to the *Neurospora crassa* gene SEQ ID NO: 5, where the cell contains at least one modification causing reduced expression of at least one of said gene(s) orthologous to the *Neurospora crassa* gene SEQ ID NO: 5, as compared with a corresponding cell lacking said modification, and, where the reduced expression of at least one of said gene(s) orthologous to the *Neurospora crassa* gene SEQ ID NO: 5 causes reduced expression of one or more of said cellulase polypeptides, as compared with expression of said cellulase polypeptides in a corresponding cell lacking said modification, and where the modification(s) are caused by RNAi, antisense RNA, T-DNA insertion, transposon insertion, insertional mutagenesis, site-directed mutagenesis, partial deletion of the gene, or complete deletion of the gene.

Also provided herein is a non-*Neurospora* cell, containing DNA encoding one or more cellulase polypeptides, at least one gene orthologous to the *Neurospora crassa* gene SEQ ID NO: 5, and at least one gene orthologous to the *Neurospora crassa* gene SEQ ID NO: 2, where the cell contains at least one modification causing reduced expression of at least one of said gene(s) orthologous to the *Neurospora crassa* gene SEQ ID NO: 5 and at least one modification causing reduced expression of one of said gene(s) orthologous to the *Neurospora crassa* gene SEQ ID NO: 2, as compared with a corresponding cell lacking said modifications, and, where the reduced expression of at least one of said gene(s) orthologous to the *Neurospora crassa* gene SEQ ID NO: 5 and at least one of said gene(s) orthologous to the *Neurospora crassa* gene SEQ ID NO: 2 causes reduced expression of one or more of said cellulase polypeptides, as compared with expression of said cellulase polypeptides in a corresponding cell lacking said modifications, and where the modification(s) are caused by RNAi, antisense RNA, T-DNA insertion, transposon insertion, insertional mutagenesis, site-directed mutagenesis, partial deletion of the gene, or complete deletion of the gene.

Also provided herein is a non-*Neurospora* cell, containing DNA encoding one or more cellulase polypeptides and at least one gene orthologous to the *Neurospora crassa* gene SEQ ID NO: 5, where the cell contains at least one modification causing reduced expression of at least one of said gene(s) orthologous to the *Neurospora crassa* gene SEQ ID NO: 5, as compared with a corresponding cell lacking said modification, and, where the reduced expression of at least one of said gene(s) orthologous to the *Neurospora crassa* gene SEQ ID NO: 5 causes reduced expression of one or more of said cellulase polypeptides, as compared with expression of said cellulase polypeptides in a corresponding cell lacking said modification, and where the cell contains one or more RNAi-inducing vectors, where the one or more vectors generate RNAi against one or more genes orthologous to the *Neurospora crassa* gene SEQ ID NO: 5.

Also provided herein is a non-*Neurospora* cell, containing DNA encoding one or more cellulase polypeptides, at least one gene orthologous to the *Neurospora crassa* gene SEQ ID NO: 5, and at least one gene orthologous to the *Neurospora crassa* gene SEQ ID NO: 2, where the cell contains at least one modification causing reduced expression of at least one of said gene(s) orthologous to the *Neurospora crassa* gene SEQ ID NO: 5 and at least one modification causing reduced expression of one of said gene(s) orthologous to the *Neurospora crassa* gene SEQ ID NO: 2, as compared with a corresponding cell lacking said modifications, and, where the reduced expression of at least one of said gene(s) orthologous to the *Neurospora crassa* gene SEQ ID NO: 5 and at least one of said gene(s) orthologous to the *Neurospora crassa* gene SEQ ID NO: 2 causes reduced expression of one or more of said cellulase polypeptides, as compared with expression of said cellulase polypeptides in a corresponding cell lacking said modifications, and where the cell contains one or more RNAi-inducing vectors, where the one or more vectors generate RNAi against one or more genes orthologous to the *Neurospora crassa* gene SEQ ID NO: 5 or SEQ ID NO: 2.

Also provided herein is a non-*Neurospora* cell, containing DNA encoding one or more cellulase polypeptides, at least one gene orthologous to the *Neurospora crassa* gene SEQ ID NO: 5, and a recombinant nucleic acid encoding a polypeptide involved in cellulose metabolism, where the cell contains at least one modification causing reduced expression of at least one of said gene(s) orthologous to the *Neurospora crassa* gene SEQ ID NO: 5, as compared with a corresponding cell lacking said modification, and, where the reduced expression of at least one of said gene(s) orthologous to the *Neurospora crassa* gene SEQ ID NO: 5 causes reduced expression of one or more of said cellulase polypeptides, as compared with expression of said cellulase polypeptides in a corresponding cell lacking said modification.

Also provided herein is a non-*Neurospora* cell, containing DNA encoding one or more cellulase polypeptides, at least one gene orthologous to the *Neurospora crassa* gene SEQ ID NO: 5, at least one gene orthologous to the *Neurospora crassa* gene SEQ ID NO: 2, and a recombinant nucleic acid encoding a polypeptide involved in cellulose metabolism, where the cell contains at least one modification causing reduced expression of at least one of said gene(s) orthologous to the *Neurospora crassa* gene SEQ ID NO: 5 and at least one modification causing reduced expression of one of said gene(s) orthologous to the *Neurospora crassa* gene SEQ ID NO: 2, as compared with a corresponding cell lacking said modifications, and, where the reduced expression of at least one of said gene(s) orthologous to the *Neurospora crassa* gene SEQ ID NO: 5 and at least one of said gene(s) orthologous to the *Neurospora crassa* gene SEQ ID NO: 2 causes reduced expression of one or more of said cellulase polypeptides, as compared with expression of said cellulase polypeptides in a corresponding cell lacking said modifications.

Additionally provided herein is a non-*Neurospora* cell, containing DNA encoding one or more cellulase polypeptides, at least one gene orthologous to the *Neurospora crassa* gene SEQ ID NO: 5, and a recombinant nucleic acid encoding a cellulase, where the cell contains at least one modification causing reduced expression of at least one of said gene(s) orthologous to the *Neurospora crassa* gene SEQ ID NO: 5, as compared with a corresponding cell lacking said modification, and, where the reduced expression of at least one of said gene(s) orthologous to the *Neurospora crassa* gene SEQ ID NO: 5 causes reduced expression of one or more of said cellulase polypeptides, as compared with expression of said cellulase polypeptides in a corresponding cell lacking said modification.

Additionally provided herein is a non-*Neurospora* cell, containing DNA encoding one or more cellulase polypeptides, at least one gene orthologous to the *Neurospora crassa* gene SEQ ID NO: 5, at least one gene orthologous to the *Neurospora crassa* gene SEQ ID NO: 2, and a recombinant nucleic acid encoding a cellulase, where the cell contains at least one modification causing reduced expression of at least one of said gene(s) orthologous to the *Neurospora crassa* gene SEQ ID NO: 5 and at least one modification causing reduced expression of one of said gene(s) orthologous to the *Neurospora crassa* gene SEQ ID NO: 2, as compared with a corresponding cell lacking said modifications, and, where the reduced expression of at least one of said gene(s) orthologous to the *Neurospora crassa* gene SEQ ID NO: 5 and at least one of said gene(s) orthologous to the *Neurospora crassa* gene SEQ ID NO: 2 causes reduced expression of one or more of said cellulase polypeptides, as compared with expression of said cellulase polypeptides in a corresponding cell lacking said modifications.

Further provided herein is a non-*Neurospora* cell, containing DNA encoding one or more cellulase polypeptides and at least one gene orthologous to the *Neurospora crassa* gene SEQ ID NO: 5, where the cell contains at least one modification causing reduced expression of at least one of said gene(s) orthologous to the *Neurospora crassa* gene SEQ ID NO: 5, as compared with a corresponding cell lacking said modification, where the reduced expression of at least one of said gene(s) orthologous to the *Neurospora crassa* gene SEQ ID NO: 5 causes reduced expression of one or more of said cellulase polypeptides, as compared with expression of said cellulase polypeptides in a corresponding cell lacking said modification, and where the host cell is selected from *Metarhizium anisopliae, Gibberella zeae, Nectria haematococca, Magnaporthe oryzae, Neurospora tetrasperma, Sordaria macrospora, Chaetomium globosum, Podospora anserina, Verticillium albo-atrum, Glomerella graminicola, Grosmannia clavigera, Sclerotinia sclerotiorum, Botryotinia fuckeliana, Aspergillus oryzae, Aspergillus nidulans, Aspergillus niger, Aspergillus fumigatus, Penicillium chrysogenum, Leptosphaeria maculans, Phaeosphaeria nodorum, Pyrenophora tritici-repentis, Pyrenophora teres, Penicillium marneffei, Talaromyces stipitatus, Trichoderma reesei, Uncinocarpus reesii, Coccidioides immitus, Coccidioides posadasii, Saccharomyces cerevisiae, Schizosaccharomyces pombe, Sporotrichum thermophile (Myceliophthora thermophila), Thielavia terrestris-thermophilic, Acremonium cellulolyticus, Yarrowia lipolytica, Hansenula polymorpha, Kluyveromyces lactis, Pichia pastoris, Mycosphaerella graminicola, Neosartorya fischeri, Thermomyces lanuginosus (Humicola brevis, Humicola brevispora, Humicola grisea, Humicola lanuginosa, Monotospora lanuginosa, Sepedonium lanuginosum), Talaromyces thermophilus (Talaromyces dupontii, Penicillium dupontii)*, or *Chrysosporium lucknowense*.

Further provided herein is a non-*Neurospora* cell, containing DNA encoding one or more cellulase polypeptides, at least one gene orthologous to the *Neurospora crassa* gene SEQ ID NO: 5, and at least one gene orthologous to the *Neurospora crassa* gene SEQ ID NO: 2, where the cell contains at least one modification causing reduced expression of at least one of said gene(s) orthologous to the *Neurospora crassa* gene SEQ ID NO: 5 and at least one modification causing reduced expression of one of said gene(s) orthologous to the *Neurospora crassa* gene SEQ ID NO: 2, as compared with a corresponding cell lacking said modifications, where the reduced expression of at least one of said gene(s) orthologous to the *Neurospora crassa* gene SEQ ID NO: 5 and at least one of said gene(s) orthologous to the *Neurospora crassa* gene SEQ ID NO: 2 causes reduced expression of one or more of said cellulase polypeptides, as compared with expression of said cellulase polypeptides in a corresponding cell lacking said modifications, and where the host cell is selected from *Metarhizium anisopliae, Gibberella zeae, Nectria haematococca, Magnaporthe oryzae, Neurospora tetrasperma, Sordaria macrospora, Chaetomium globosum, Podospora anserina, Verticillium albo-atrum, Glomerella graminicola, Grosmannia clavigera, Sclerotinia sclerotiorum, Botryotinia fuckeliana, Aspergillus oryzae, Aspergillus nidulans, Aspergillus niger, Aspergillus fumigatus, Penicillium chrysogenum, Leptosphaeria maculans, Phaeosphaeria nodorum, Pyrenophora tritici-repentis, Pyrenophora teres, Penicillium marneffei, Talaromyces stipitatus, Trichoderma reesei, Uncinocarpus reesii, Coccidioides immitus, Coccidioides posadasii, Saccharomyces cerevisiae, Schizosaccharomyces pombe, Sporotrichum thermophile (Myceliophthora thermophila), Thielavia terrestris-thermophilic, Acremonium cellulolyticus, Yarrowia lipolytica, Hansenula polymorpha, Kluyveromyces lactis, Pichia pastoris, Mycosphaerella graminicola, Neosartorya fischeri, Thermomyces lanuginosus (Humicola brevis, Humicola brevispora, Humicola grisea, Humicola lanuginosa, Monotospora lanuginosa, Sepedonium lanuginosum), Talaromyces thermophilus (Talaromyces dupontii, Penicillium dupontii)*, or *Chrysosporium lucknowense*.

In another embodiment, provided herein is a fungal host cell containing a recombinant nucleic acid encoding a clr-2 transcription factor protein, where the cell further contains one or more recombinant nucleic acids that encode a polypeptide involved in a biochemical pathway for the production of a biofuel.

In another embodiment, provided herein is a fungal host cell containing a recombinant nucleic acid encoding a clr-2 transcription factor protein and a recombinant nucleic acid encoding a clr-1 transcription factor protein, where the cell further contains one or more recombinant nucleic acids that encode a polypeptide involved in a biochemical pathway for the production of a biofuel.

In another embodiment, provided herein is a non-naturally occurring fungal cell, where the cell naturally contains genes encoding clr-1 and clr-2 proteins, and where the cell contains modifications causing reduced expression of one or both of the clr-1 and clr-2 proteins, as compared to the expression of the clr-1 and clr-2 proteins in a corresponding fungal cell lacking said modifications, where the cell further contains one or more recombinant nucleic acids that encode a polypeptide involved in a biochemical pathway for the production of a biofuel.

Also provided herein is a fungal host cell containing a recombinant nucleic acid encoding a clr-2 transcription factor protein, where the cell further contains one or more recombinant nucleic acids that encode a polypeptide involved in a biochemical pathway for the production of a biofuel, and where the biofuel is selected from ethanol, n-propanol, n-butanol, iso-butanol, 3-methyl-1-butanol, 2-methyl-1-butanol, 3-methyl-1-pentanol, and octanol.

Also provided herein is a fungal host cell containing a recombinant nucleic acid encoding a clr-2 transcription factor protein and a recombinant nucleic acid encoding a clr-1 transcription factor protein, where the cell further contains one or more recombinant nucleic acids that encode a polypeptide involved in a biochemical pathway for the production of a biofuel, and where the biofuel is selected from ethanol, n-propanol, n-butanol, iso-butanol, 3-methyl-1-butanol, 2-methyl-1-butanol, 3-methyl-1-pentanol, and octanol.

Also provided herein is a non-naturally occurring fungal cell, where the cell naturally contains genes encoding clr-1 and clr-2 proteins, and where the cell contains modifications causing reduced expression of one or both of the clr-1 and clr-2 proteins, as compared to the expression of the clr-1 and clr-2 proteins in a corresponding fungal cell lacking said modifications, where the cell further contains one or more recombinant nucleic acids that encode a polypeptide involved in a biochemical pathway for the production of a biofuel, and where the biofuel is selected from ethanol, n-propanol, n-butanol, iso-butanol, 3-methyl-1-butanol, 2-methyl-1-butanol, 3-methyl-1-pentanol, and octanol.

Further provided herein is a method of converting a cellulose-containing material to fermentation product, the method including contacting the cellulose-containing material with a fungal host cell containing a recombinant nucleic acid encoding a clr-2 transcription factor protein, and where the cell further contains one or more recombinant nucleic acids that encode a polypeptide involved in a biochemical pathway for the production of a biofuel.

Further provided herein is a method of converting a cellulose-containing material to fermentation product, the method including contacting the cellulose-containing material with a fungal host cell containing a recombinant nucleic acid encoding a clr-2 transcription factor protein and a recombinant nucleic acid encoding a clr-1 transcription factor protein, and where the cell further contains one or more recombinant nucleic acids that encode a polypeptide involved in a biochemical pathway for the production of a biofuel.

Further provided herein is a method of converting a cellulose-containing material to fermentation product, the method including contacting the cellulose-containing material with a non-naturally occurring fungal cell, where the cell naturally contains genes encoding clr-1 and clr-2 proteins, and where the cell contains modifications causing reduced expression of one or both of the clr-1 and clr-2 proteins, as compared to the expression of the clr-1 and clr-2 proteins in a corresponding fungal cell lacking said modifications, and where the cell further contains one or more recombinant nucleic acids that encode a polypeptide involved in a biochemical pathway for the production of a biofuel.

BRIEF DESCRIPTION OF THE DRAWINGS

The patent or application file contains at least one drawing executed in color. Copies of this patent or patent application publication with color drawings will be provided by the office upon request and payment of the necessary fee.

FIG. 1 depicts expression patterns for secreted enzymes after media shift.

FIG. 3 depicts a comparison of differentially expressed genes from RNAseq and microarray data. Both Cellulose (CMM) vs. no-carbon (NC) and Cellulose vs. sucrose (SMM) conditions are compared.

FIG. 4 depicts growth and enzyme secretion of deletion strains for cdr-1 (clr-1) and cdr-2 (clr-2).

FIG. 6A depicts cdr-1. FIG. 6B depicts cdr-2.

FIG. 7 depicts altered expression profiles in cdr (clr) deletion mutants.

FIG. 9 depicts phylogenetic trees based on Bayesian inference.

FIG. 14 depicts hierarchical clustering of the *N. crassa* Avicel® regulon by FPKM in alternative inducing conditions and clr mutants.

FIG. 17 depicts the phenotype of *A. nidulans* clr deletion strains ΔclrA and ΔclrB.

FIG. 19 depicts growth of an *N. crassa* clrA mis-expression strain and an *N. crassa* clrB mis-expression strain on cellobiose and Avicel®.

DETAILED DESCRIPTION

Figure 1A:
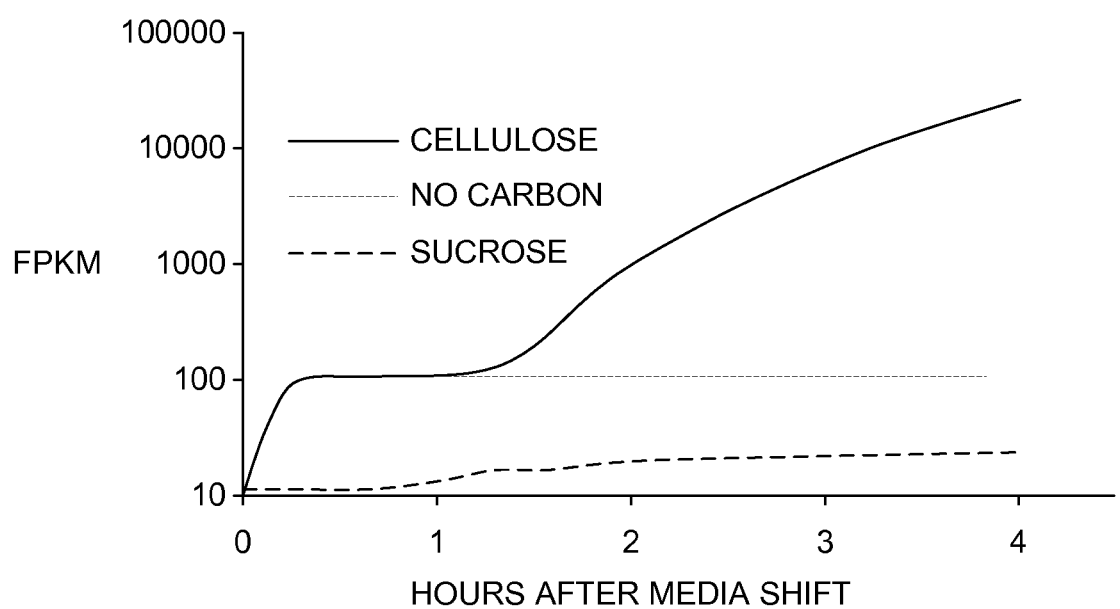
FIG. 1A depicts typical expression patterns for secreted enzymes after shift to no carbon or a new carbon source.

Provided herein are polypeptides involved in the response of cells to cellulose. Further provided herein are nucleic acids encoding polypeptides involved in the response of cells to cellulose. Also provide herein are host cells containing recombinant nucleic acids encoding polypeptides involved in the response of cells to cellulose, and host cells containing recombinant polypeptides involved in the response of cells to cellulose. In some aspects, provided herein are the polypeptides clr-1 and clr-2, and nucleic acids encoding clr-1 and clr-2 polypeptides.

Further provided herein are methods for use of clr-1 and clr-2 polypeptides, methods for use of nucleic acids encoding clr-1 and clr-2 polypeptides, and methods for use of host cells containing recombinant clr-1 and/or clr-2 polypeptides or nucleic acids encoding clr-1 and/or clr-2 polypeptides. In some aspects, clr-1 and clr-2 promote the expression of cellulases and other genes in response to cellulose. Accordingly, in some aspects, the expression of recombinant clr-1 and/or clr-2 in a host cell increases the growth rate of a host cell on media containing cellulose, increases the production of cellulases from the host cell, and/or increases the rate of cellulose degradation by the host cell.

In addition, provided herein are cells that naturally produce clr-1 and/or clr-2 polypeptides, which are modified to have reduced expression of clr-1 and/or clr-2. Cells which naturally produce clr-1 and/or clr-2 polypeptides, but which are modified to have reduced expression of clr-1 and/or clr-2 may be used, for example to study cellulases and the response of cells to cellulose.

As used herein the terms "cdr-1" and "clr-1" are used interchangeably and refer to polypeptides or genes encoding polypeptides that function as transcription factors that regulate the transcription of various genes in a fungal cell in response to the exposure of the cell to cellulose. One non-limiting example of a clr-1 encoding gene is the *N. crassa* gene NCU07705.

As used herein the terms "cdr-2" and "clr-2" are used interchangeably and refer to polypeptides or genes encoding polypeptides that function as transcription factors that regulate the transcription of various genes in a fungal cell in response to the exposure of the cell to cellulose. One non-limiting example of a clr-2 encoding gene is the *N. crassa* gene NCU08042.

Accordingly, in certain aspects the present disclosure relates to a method of degrading cellulose-containing material, by: a) contacting cellulose-containing material with a fungal host cell containing at least one recombinant nucleic acid encoding a transcription factor protein, where the transcription factor protein contains a zinc(2)-cysteine(6) binuclear cluster domain, a PFAM04082 transcription factor domain, and at least one, at least two, at least three, or at least four polypeptide sequences selected from SEQ ID NOs: 184, 185, 186, and 187; and b) incubating the fungal host cell and cellulose-containing material under conditions sufficient for the fungal host cell to degrade the cellulose-containing material.

Other aspects the present disclosure relates to a method of increasing the production of one or more cellulases from a fungal cell, by: (a) providing a fungal host cell containing at least one recombinant nucleic acid encoding a transcription factor protein, where the transcription factor protein contains a zinc(2)-cysteine(6) binuclear cluster domain, a PFAM04082 transcription factor domain, and at least one, at least two, at least three, or at least four polypeptide sequences selected from SEQ ID NOs: 184, 185, 186, and 187; and (b) culturing the host cell under conditions sufficient to support the expression of the at least one recombinant nucleic acid, where the fungal host cell produces a greater amount of the one or more cellulases than a corresponding host cell lacking the at least one recombinant nucleic acid.

Other aspects the present disclosure relates to a method of reducing the viscosity of a pretreated biomass material, by contacting pretreated biomass material with a fungal host cell containing at least one recombinant nucleic acid encoding a transcription factor protein, to yield a pretreated biomass material having reduced viscosity, where the transcription factor protein contains a zinc(2)-cysteine(6) binuclear cluster domain, a PFAM04082 transcription factor domain, and at least one, at least two, at least three, or at least four polypeptide sequences selected from SEQ ID NOs: 184, 185, 186, and 187.

Polypeptides of the Disclosure

The present disclosure relates to polypeptides that are involved in the transcription of genes related to cellulose metabolism. In some aspects, the disclosure relates to clr-1 polypeptides. In some aspects, the disclosure relates to clr-2 polypeptides.

As used herein, a "polypeptide" is an amino acid sequence including a plurality of consecutive polymerized amino acid residues (e.g., at least about 15 consecutive polymerized amino acid residues). As used herein, "polypeptide" refers to an amino acid sequence, oligopeptide, peptide, protein, or portions thereof, and the terms "polypeptide" and "protein" are used interchangeably.

Clr-1

In some aspects, the present disclosure relates to clr-1 polypeptides. Clr-1 polypeptides function as transcription factors that regulate the transcription of various genes in a fungal cell in response to the exposure of the cell to cellulose. In some aspects, the expression of a gene is increased in response to clr-1 expression. In some aspects, the expression of a gene is decreased in response to clr-1 expression.

Clr-1 is a member of the fungal specific zinc binuclear cluster superfamily, which is large, diverse superfamily of fungal-specific transcriptional regulators. Examples of transcription factors in this superfamily include gal-4, ace-1, and xlnR (xyr-1) (Stricker et al., *App. Micro. Biotech.*, 78: 211-220 (2008)). Clr-2 is also a member of this superfamily.

Members of this polypeptide superfamily typically contain two conserved domains: A) a zinc(2)-cysteine(6) binuclear cluster PFAM00172 domain, which coordinates binding of the polypeptide to the DNA, and B) a central domain, which roughly corresponds to what is known as the "middle homology region" (Campbell R N, Biochemical J., 414: 177-187, (2008)), a conserved domain in zinc finger transcription factors. In clr-1, the conserved central domain has the fungal-specific transcription factor domain PFAM04082.

Figure 21:
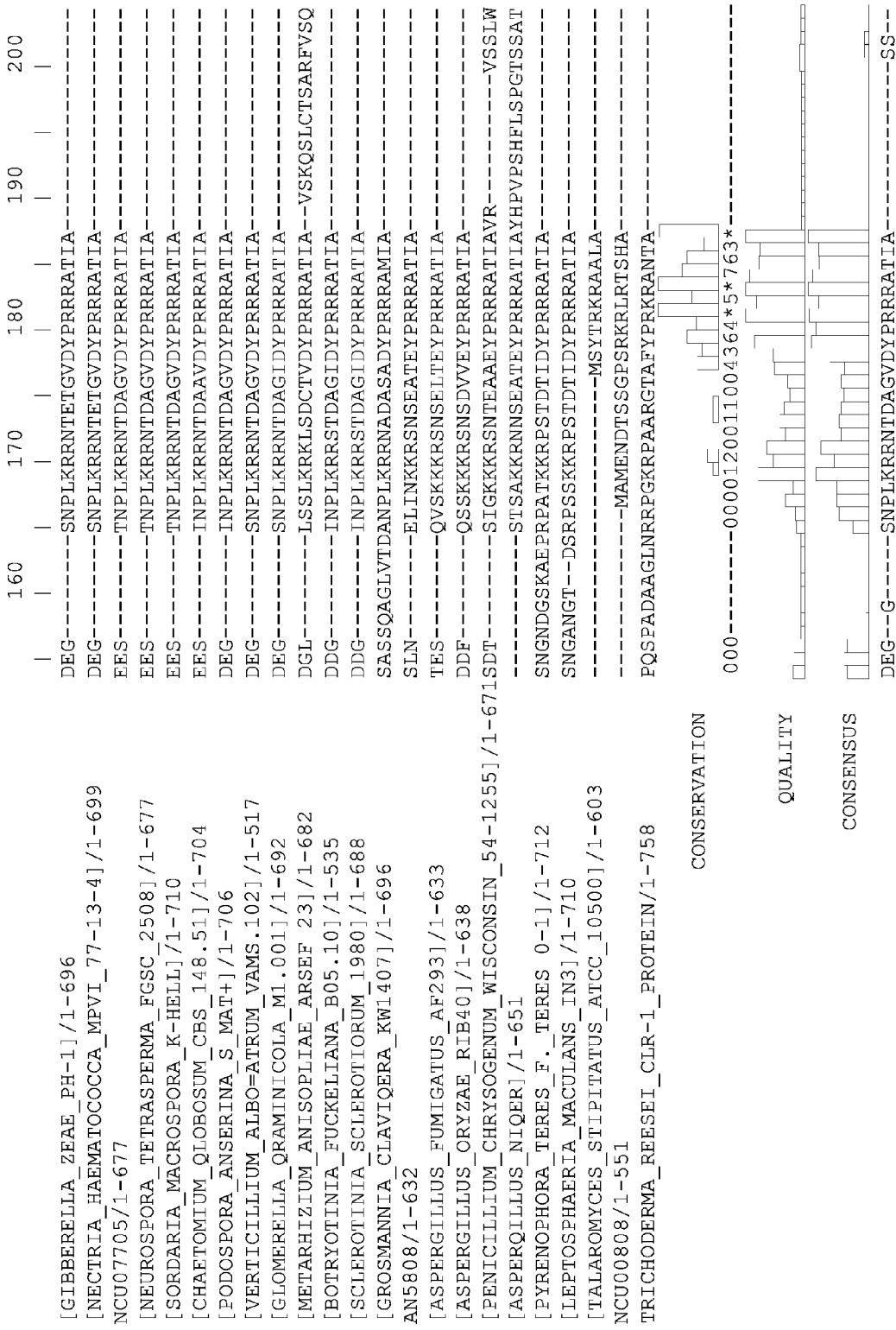
FIG. 21 depicts an amino acid sequence alignment of *N. crassa* clr-1 with 22 clr-1 homologs showing conserved motifs. The conserved PFAM04082 transcription factor domain is depicted at amino acid residues 435-760 of the consensus sequence shown at the bottom of FIG. 21. The sequence alignment included the following sequences: *Gibberella_zeae*_PH-1 (SEQ ID NO: 193), *Nectria_haematococca*_mpVI_77-13-4 (SEQ ID NO: 194), NCU07705 (SEQ ID NO: 2), *Neurospora_tetrasperma*_FGSC_2508 (SEQ ID NO: 195), *Sordaria_macrospora*_k-hell (SEQ ID NO: 196), *Chaetomium_globosum*_CBS_148.51 (SEQ ID NO: 197), *Podospora_anserina*_S_mat+ (SEQ ID NO: 198), *Verticillium_albo-atrum*_VaMs. 102 (SEQ ID NO: 199), *Glomerella_graminicola*_M1.001 (SEQ ID NO: 200), *Metarhizium_anisopliae*_ARSEF_23 (SEQ ID NO: 201), *Botryotinia_fuckeliana*_B05.10 (SEQ ID NO: 202), *Sclerotinia_sclerotiorum*_1980 (SEQ ID NO: 203), *Grosmannia_clavigera*_kw1407 (SEQ ID NO: 204), AN5808 (SEQ ID NO: 205), *Aspergillus_fumigatus*_Af293 (SEQ ID NO: 206), *Aspergillus_oryzae*_RIB40 (SEQ ID NO: 207), *Penicillium_chrysogenum*_Wisconsin_54-1255 (SEQ ID NO: 208), *Aspergillus_niger* (SEQ ID NO: 209), *Pyrenophora_teres_f._teres*_0-1 (SEQ ID NO: 210), *Leptosphaeria_maculans*_JN3 (SEQ ID NO: 211), *Talaromyces_stipitatus*_ATCC_10500 (SEQ ID NO: 212), NCU00808 (SEQ ID NO: 213), and *Trichoderma_reesei*_clr-1 protein (SEQ ID NO: 182). A consensus sequence (SEQ ID NO: 241) is shown at the bottom of FIG. 21.
Figure 21:
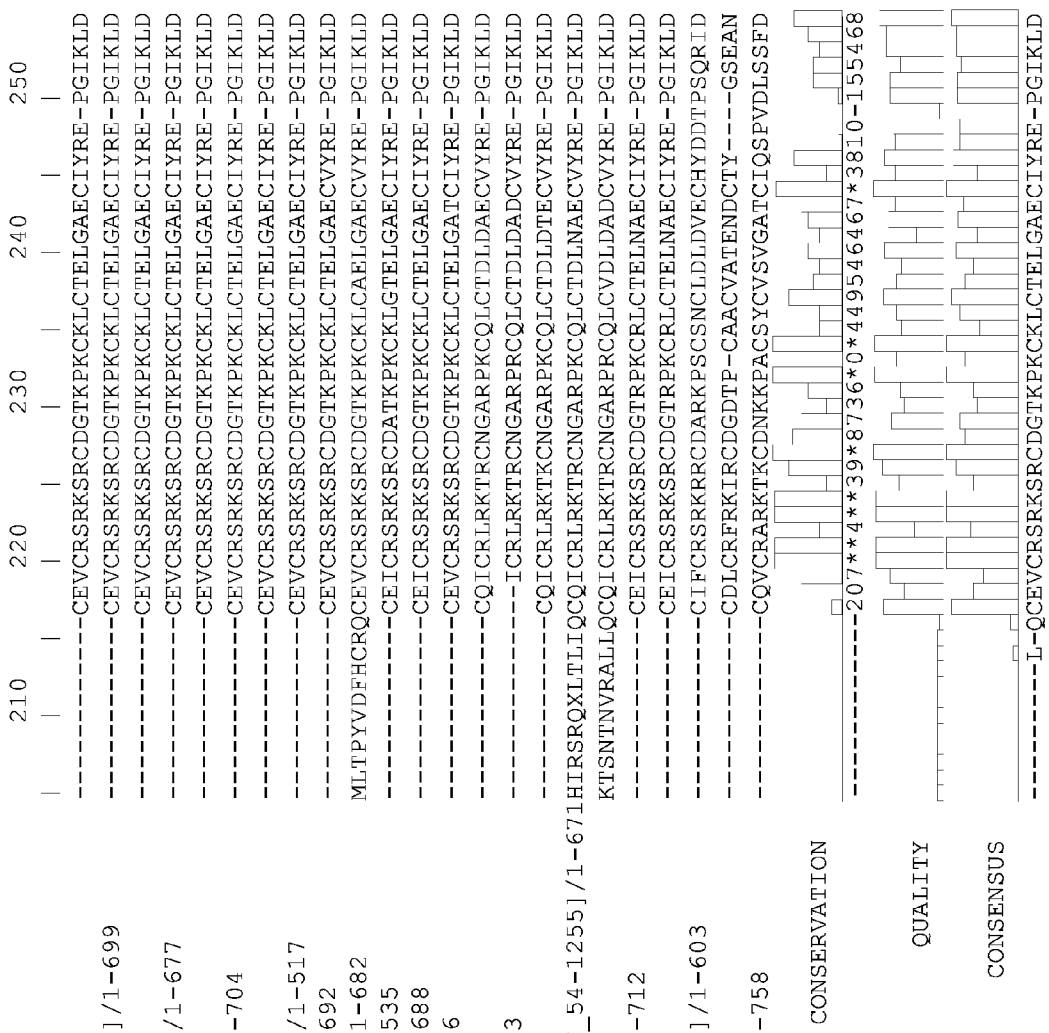
Figure 21:
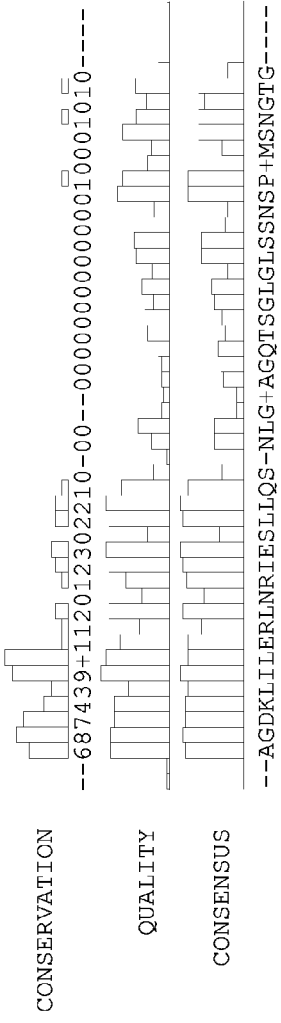
Figure 21:
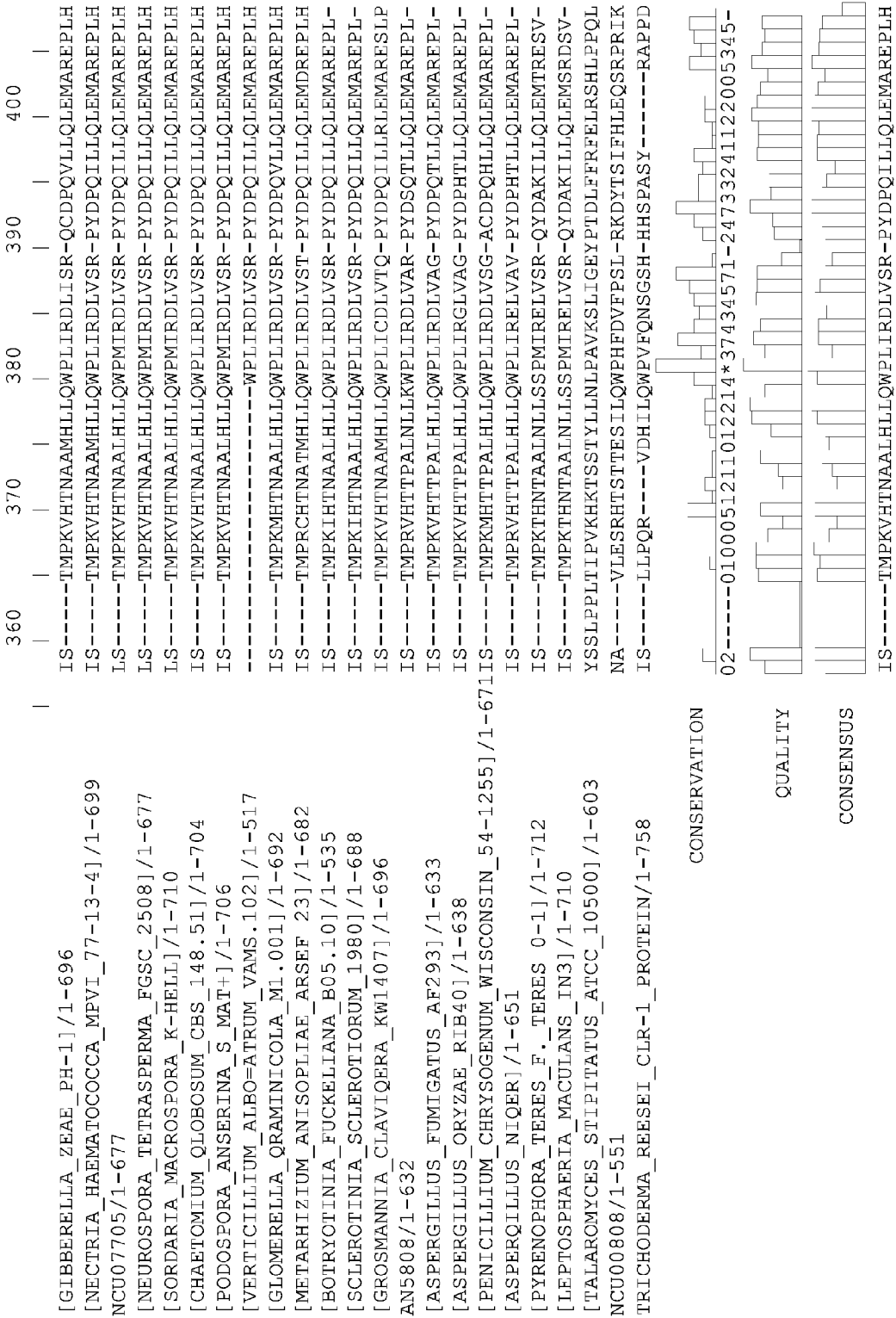
Figure 21:
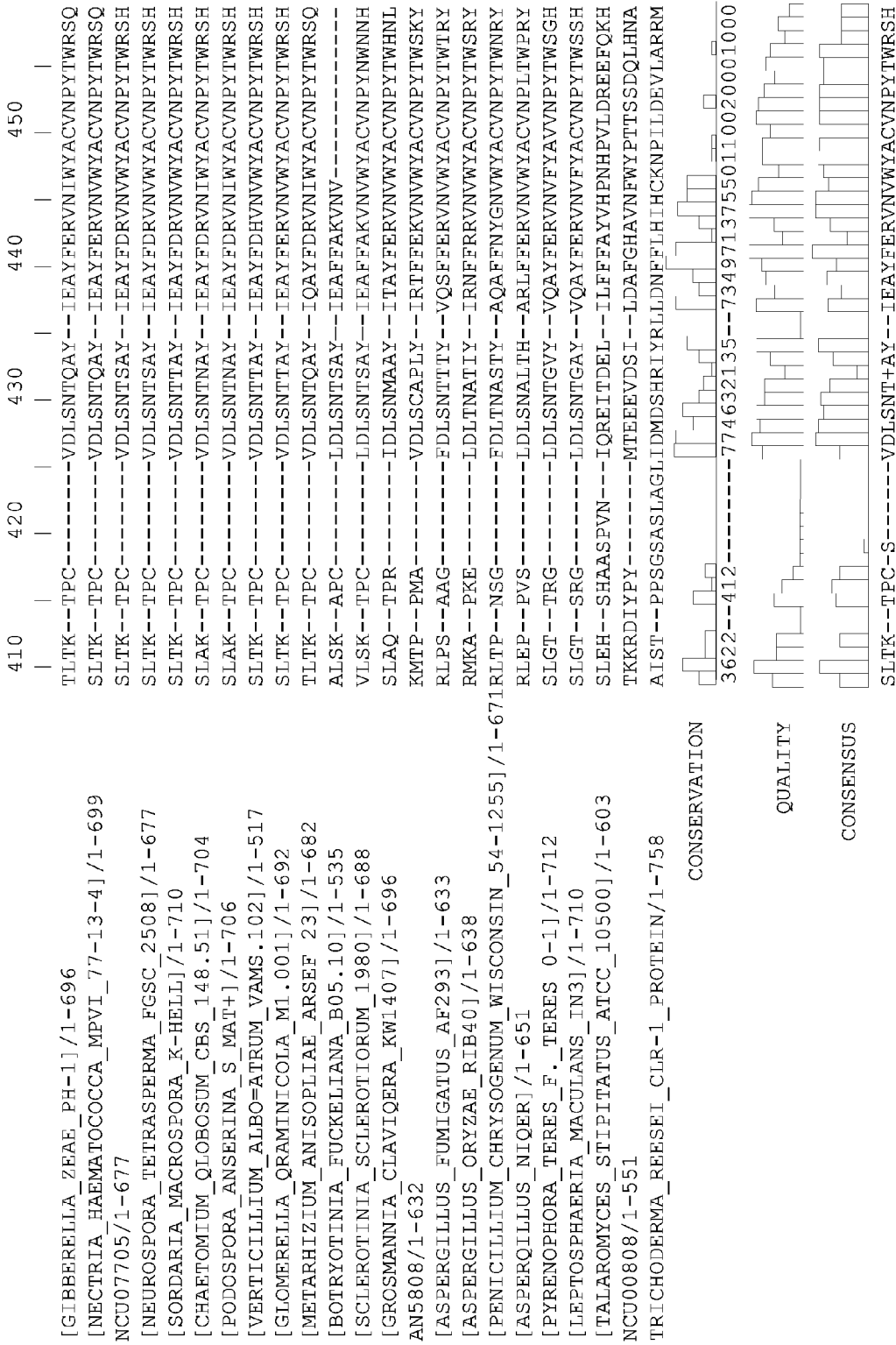
Figure 21:
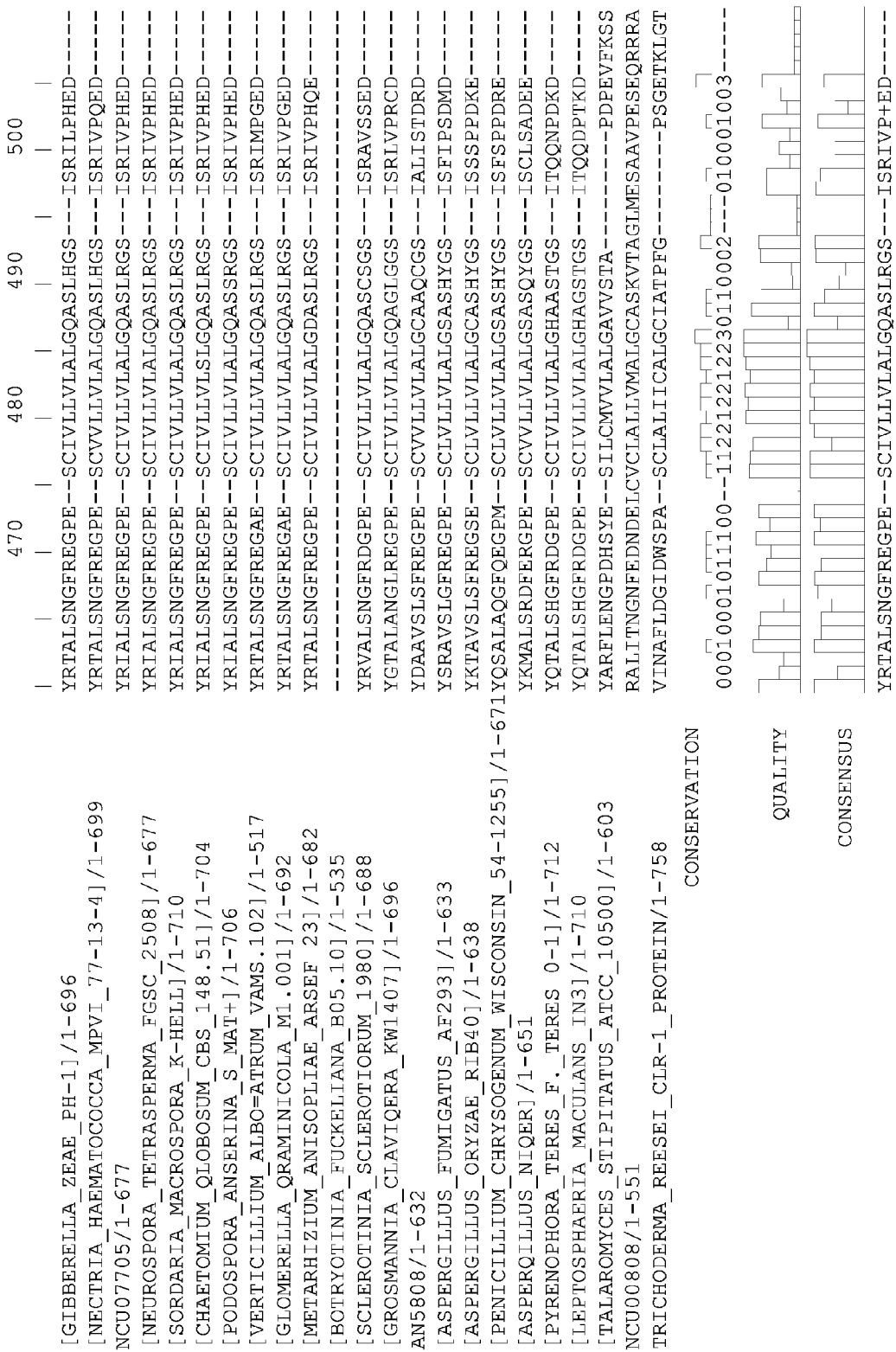
Figure 21:
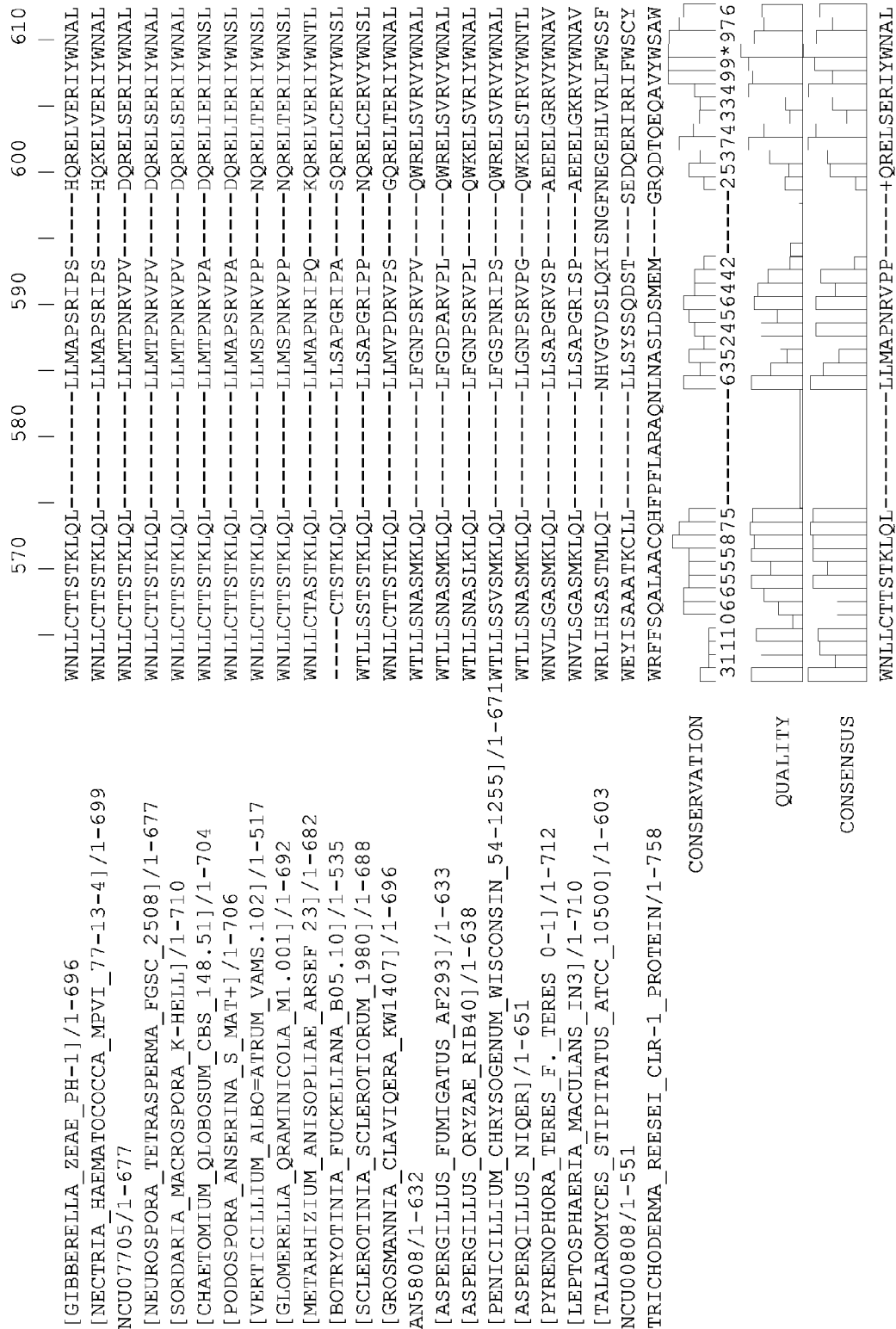
Figure 21:
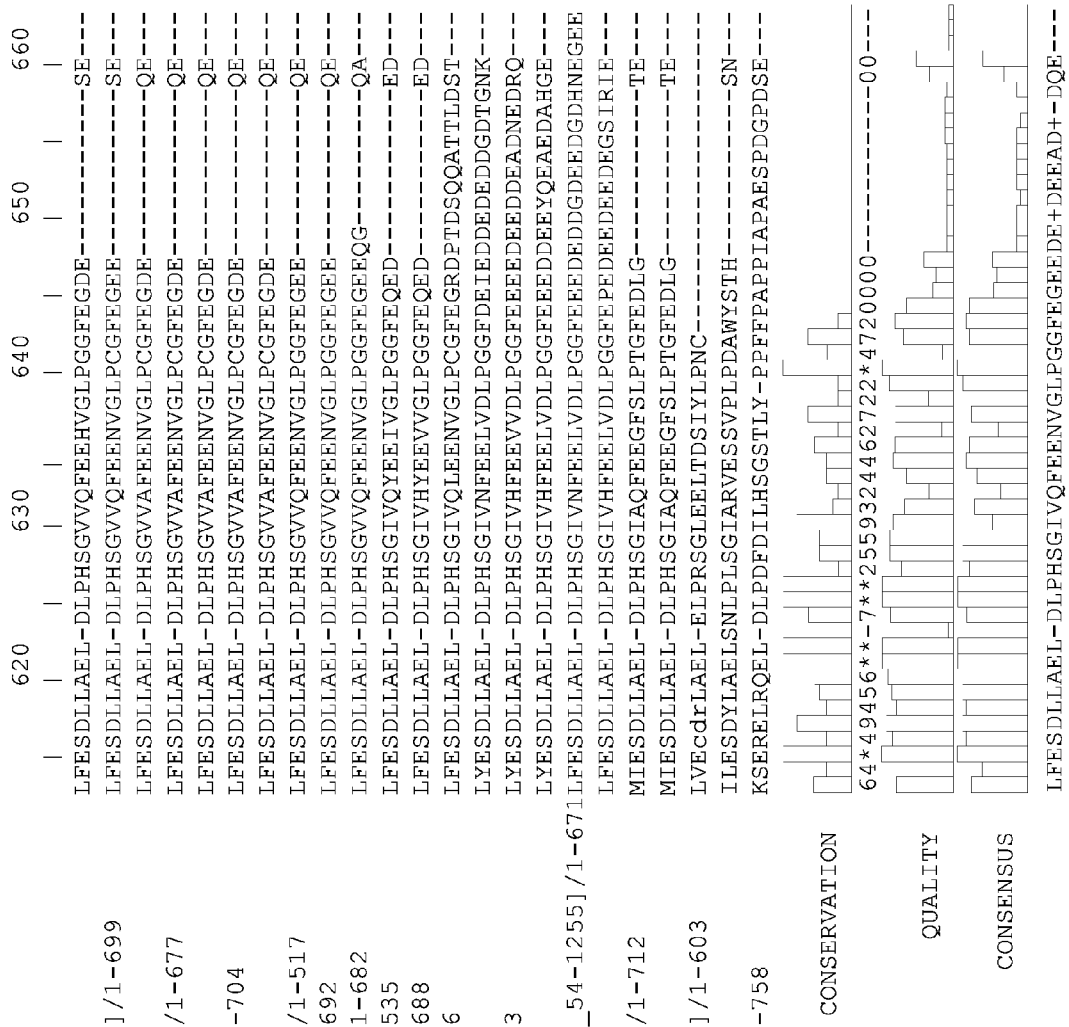
Figure 21:
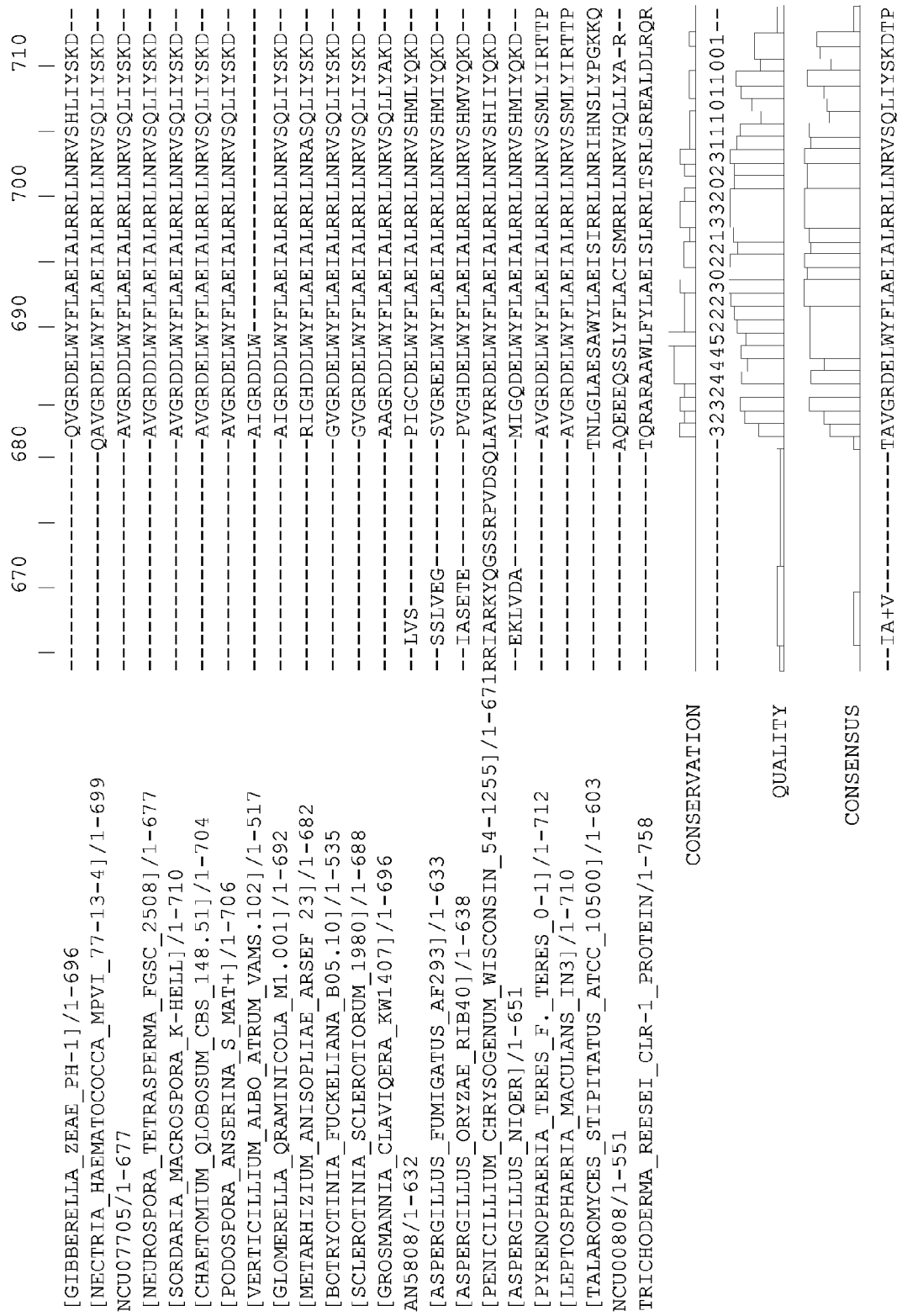
Figure 21:
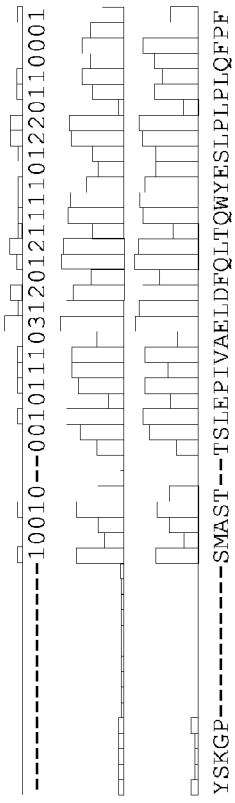
Figure 21:
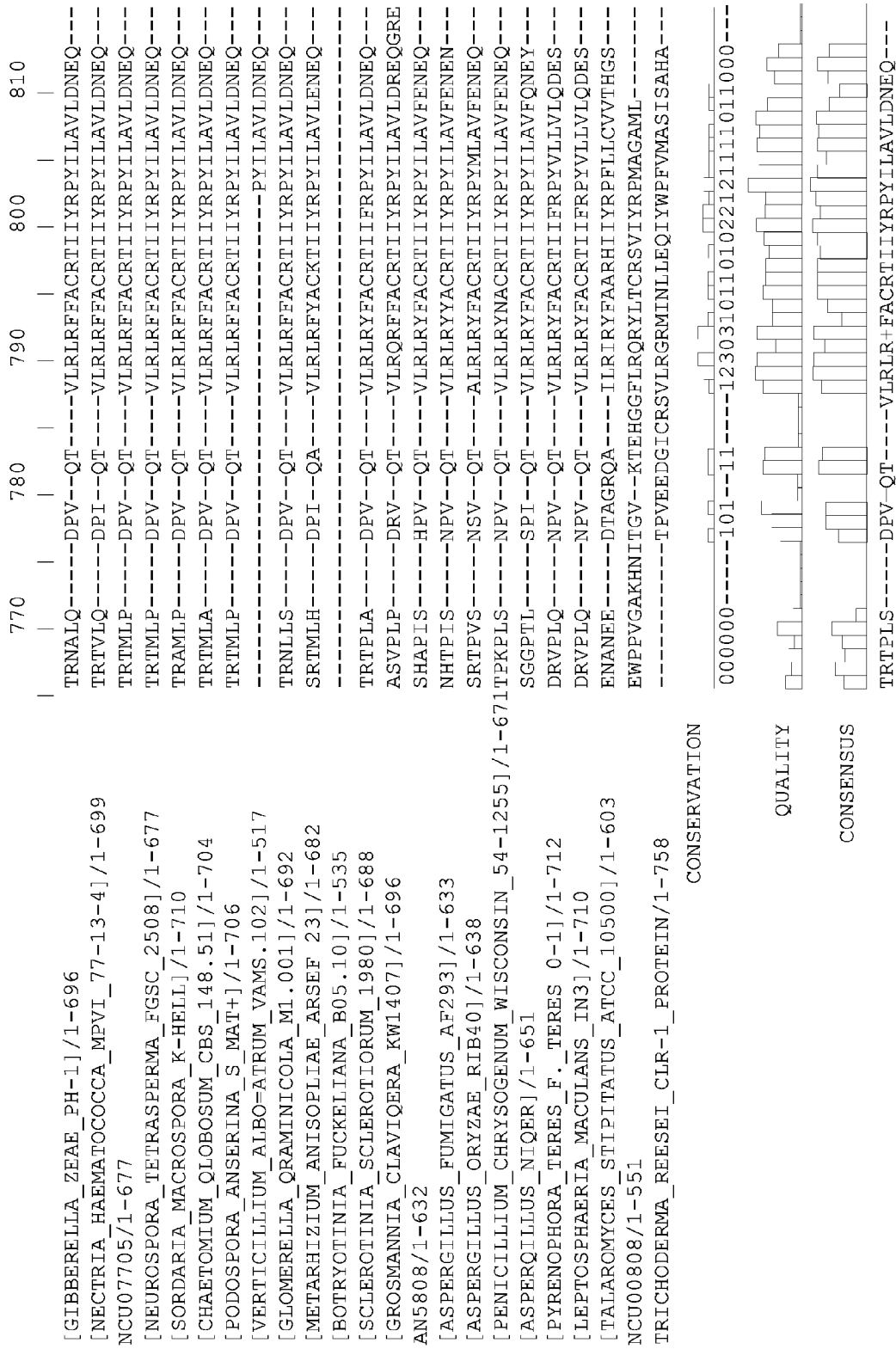
Figure 22:
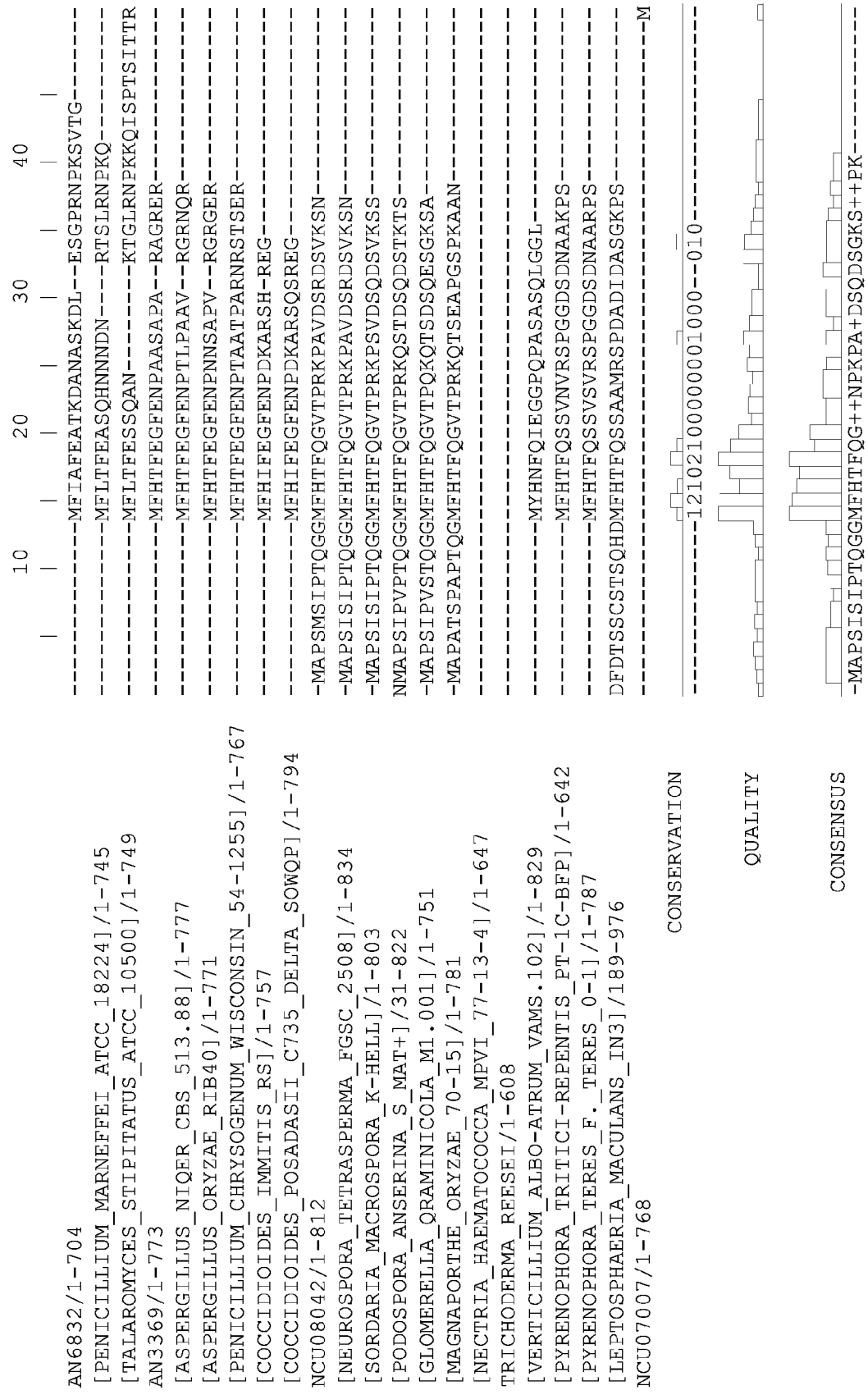
FIG. 22 depicts an amino acid sequence alignment of *N. crassa* clr-1 with 21 clr-2 homologs showing conserved motifs. The conserved PFAM04082 transcription factor domain is depicted at amino acid residues 368-555 of the consensus sequence shown at the bottom of FIG. 22. The sequence alignment included the following sequences: AN6832 (SEQ ID NO: 214), *Penicillium_marneffei*_ATCC_18224 (SEQ ID NO: 215), *Talaromyces_stipitatus*_ATCC_10500 (SEQ ID NO: 216), AN3369 (SEQ ID NO: 217), *Aspergillus_niger*_CBS_513.88 (SEQ ID NO: 218), *Aspergillus_oryzae*_RIB40 (SEQ ID NO: 219), *Penicillium_chrysogenum*_Wisconsin_54-1255 (SEQ ID NO: 220), *Coccidioides_immitis*_RS (SEQ ID NO: 221), *Coccidioides_posadasii*_C735_delta_SOWgp (SEQ ID NO: 222), NCU08042 (SEQ ID NO: 4), *Neurospora_tetrasperma*_FGSC_2508 (SEQ ID NO: 223), *Sordaria_macrospora*_k-hell (SEQ ID NO: 224), *Podospora_anserina*_S_mat+ (SEQ ID NO: 225), *Glomerella_graminicola*_M10.001 (SEQ ID NO: 226), *Magnaporthe_oryzae*_70-15 (SEQ ID NO: 227), *Nectria_haematococca*_mpVI_77-13-4 (SEQ ID NO: 228), *Trichoderma_reesei* (SEQ ID NO: 229), *Verticillium_albo-atrum*_VaMs.102 (SEQ ID NO: 230), *Pyrenophora_tritici-repentis*_Pt-1C-BFP (SEQ ID NO: 231), *Pyrenophora_teres_f._teres*_0-1 (SEQ ID NO: 232), *Leptosphaeria_maculans*_JN3 (SEQ ID NO: 233), and NCU07007 (SEQ ID NO: 234). A consensus sequence (SEQ ID NO: 242) is shown at the bottom of FIG. 22.
Figure 22:
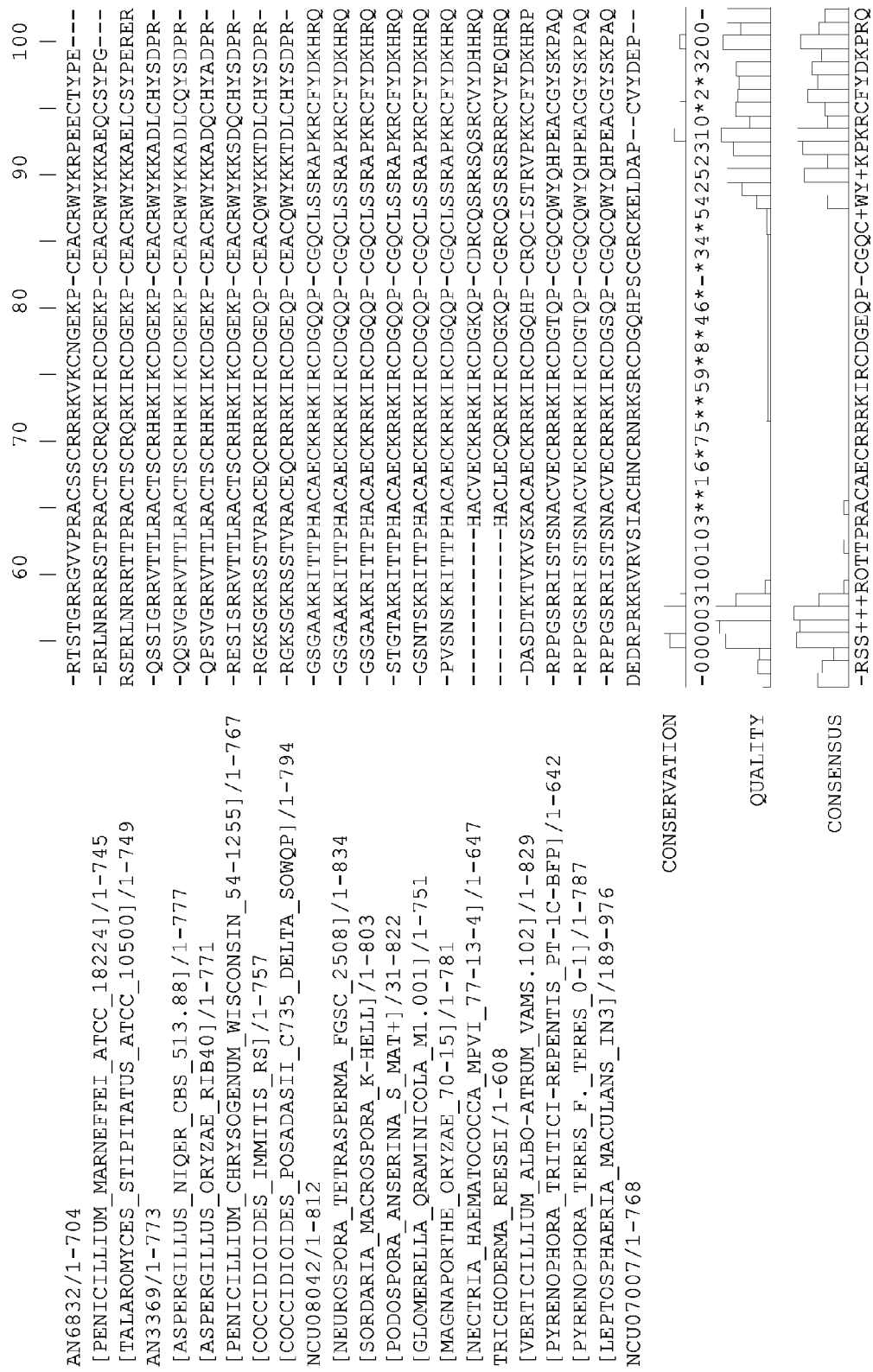
Figure 22:
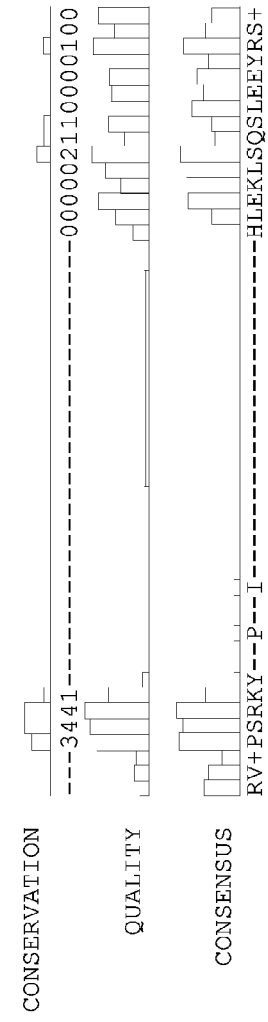
Figure 22:
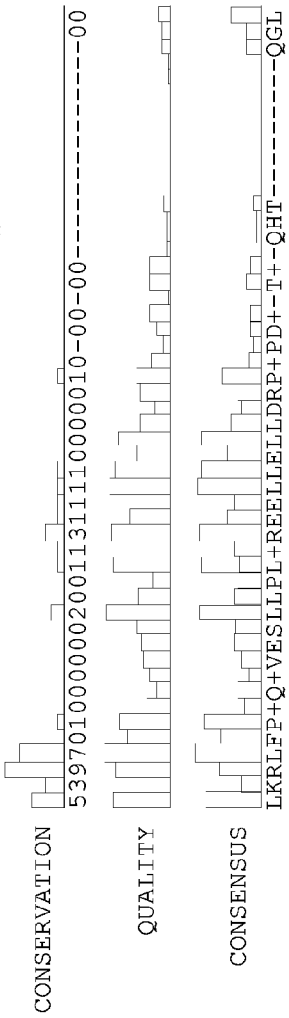
Figure 22:
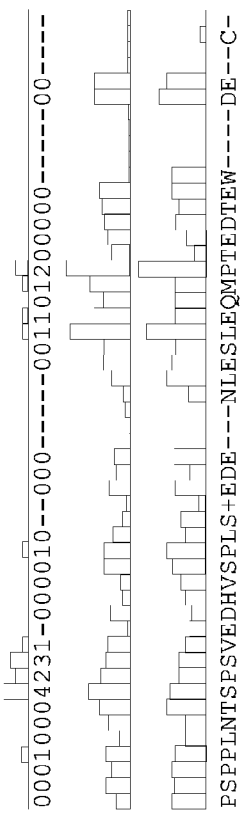
Figure 22:
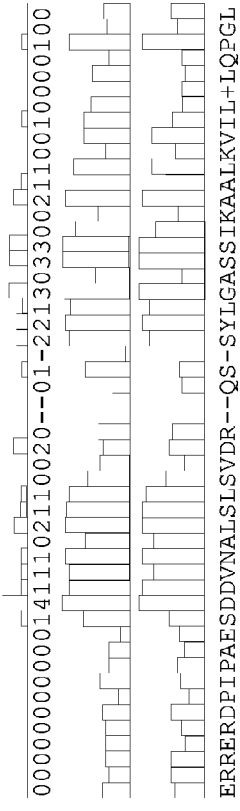
Figure 22:
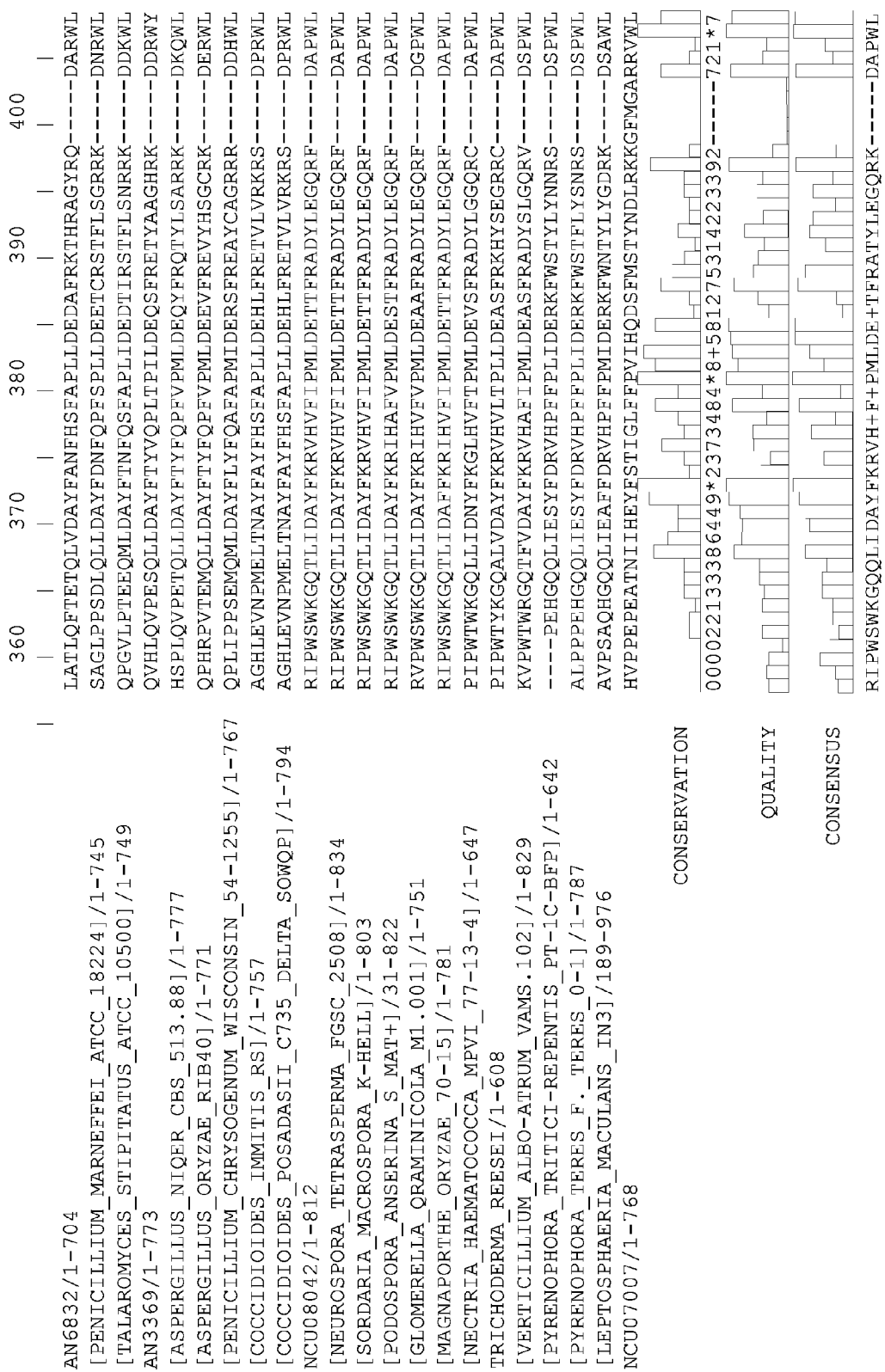
Figure 22:
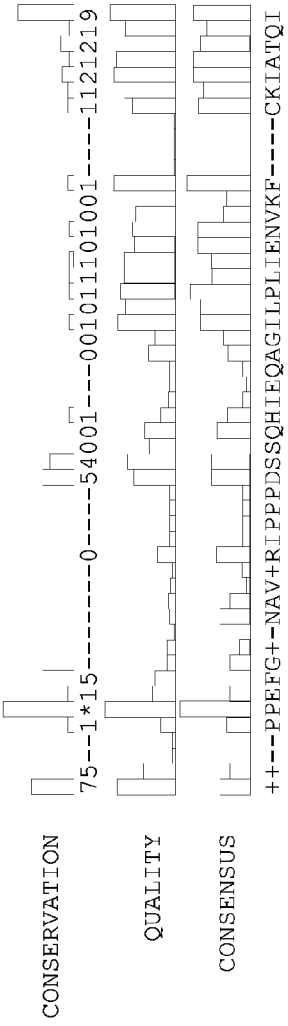
Figure 22:
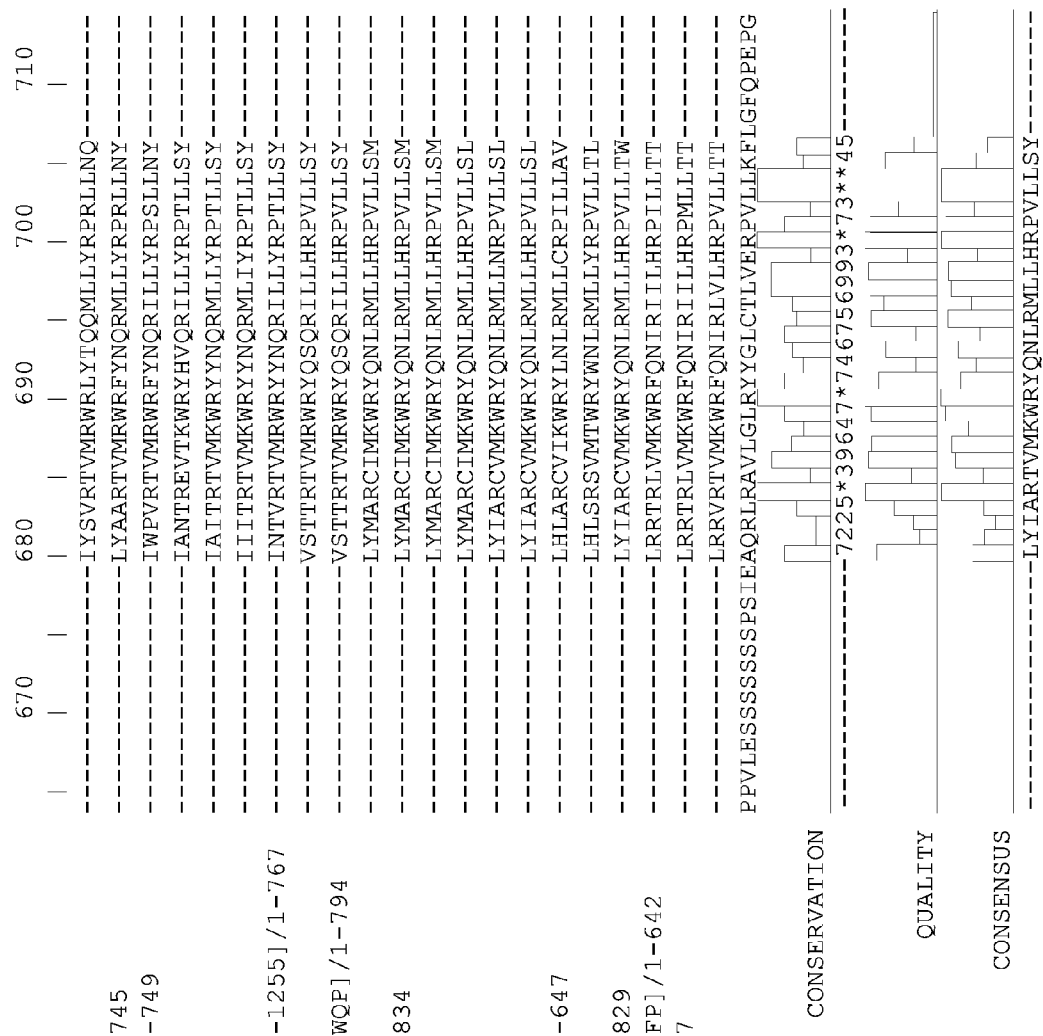
Figure 22:
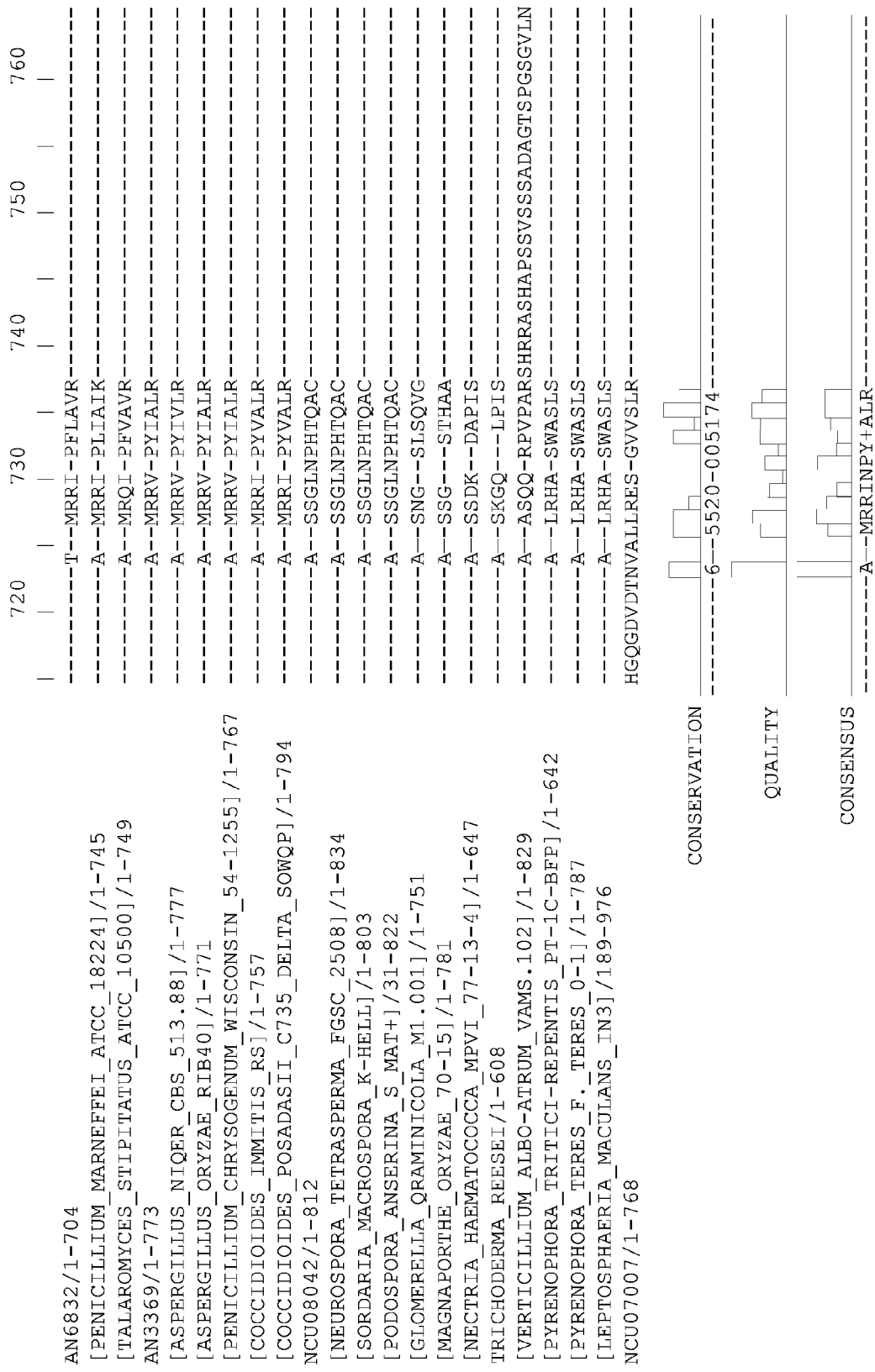
Figure 22:
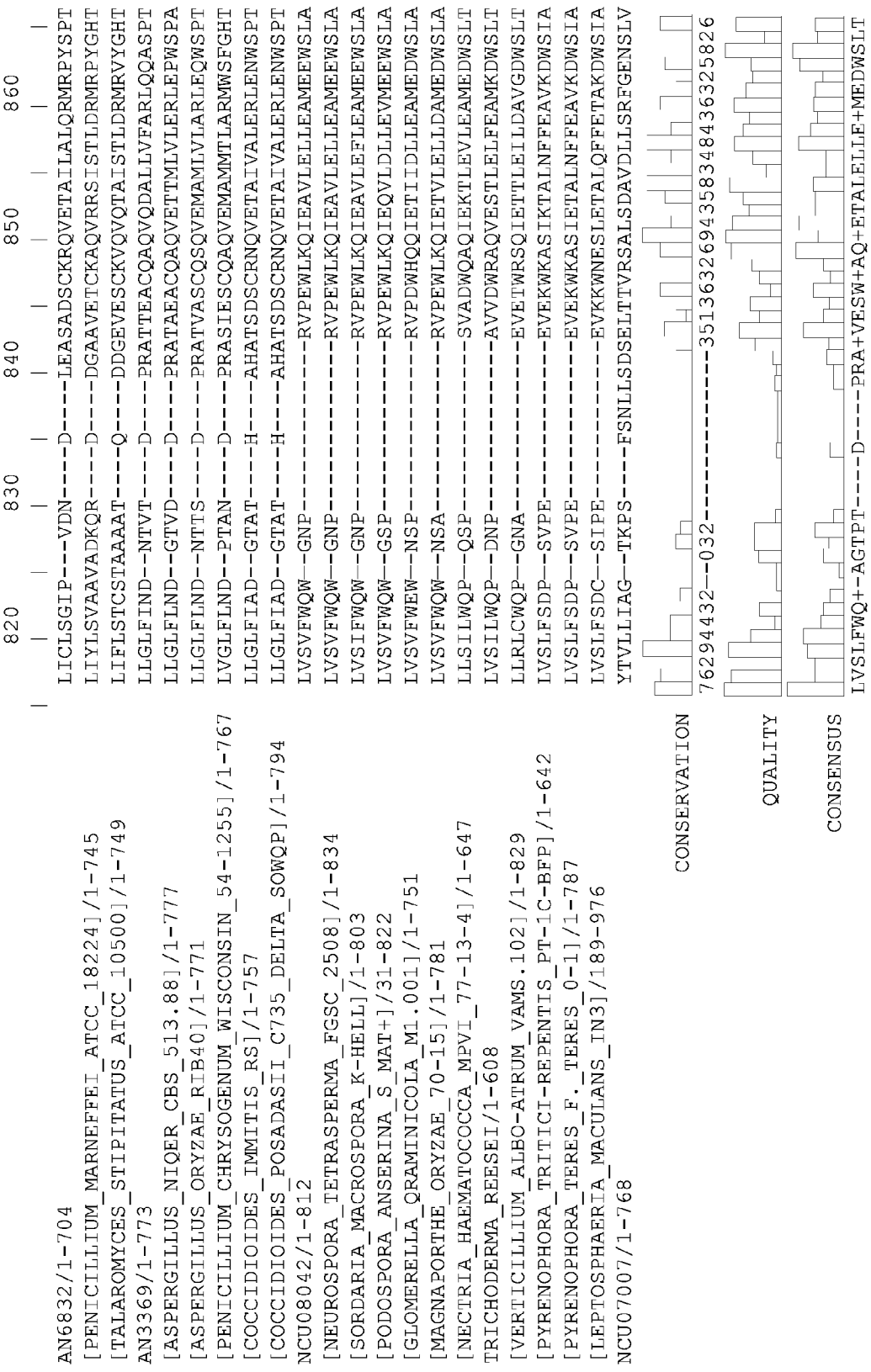
Figure 22:
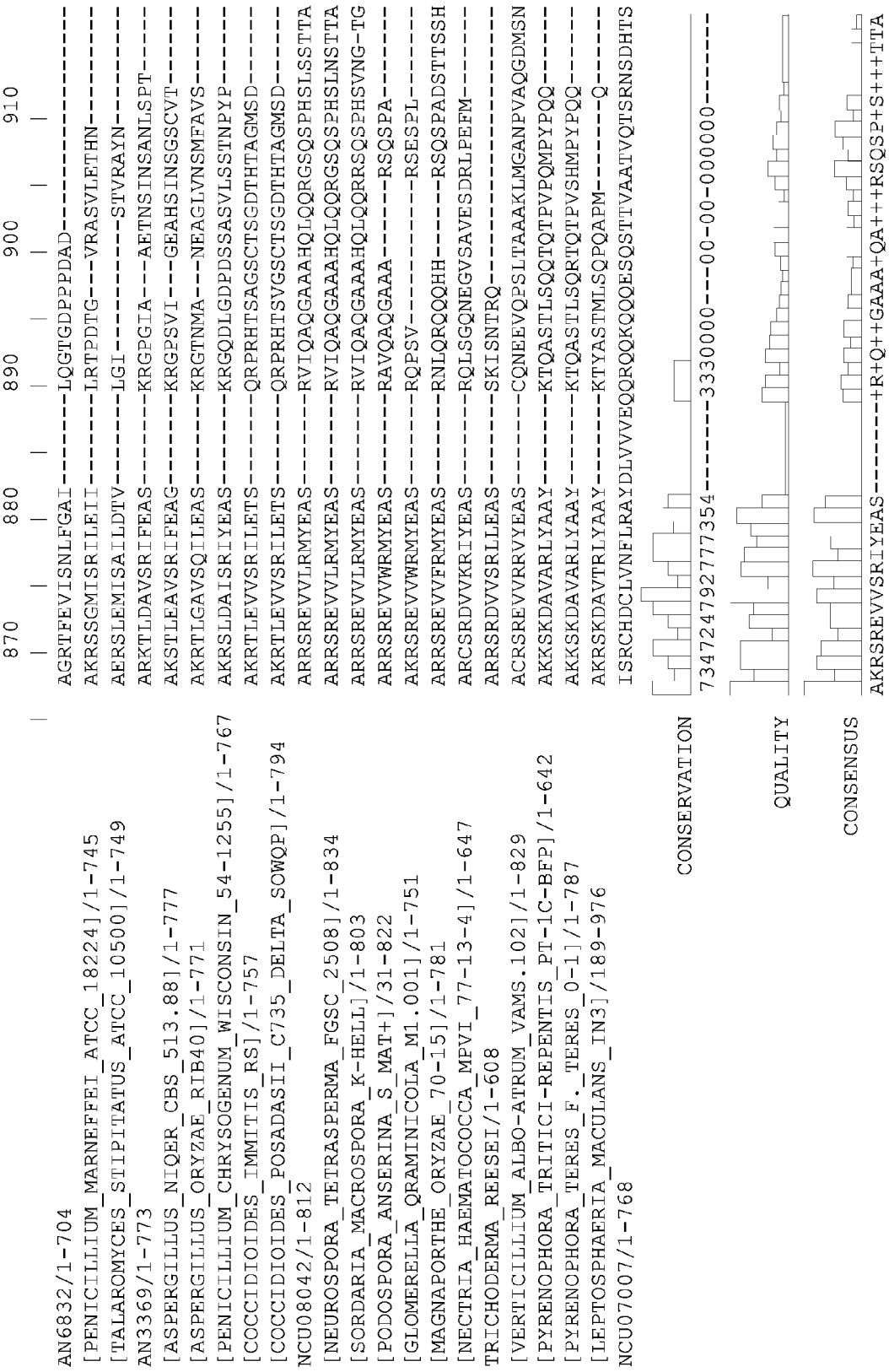
Figure 22:
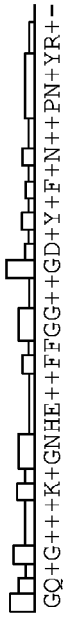

As used herein, a "zinc(2)-cysteine(6) binuclear cluster domain" refers to the conserved DNA-binding domain of the fungal specific zinc binuclear cluster superfamily, typified by *Saccharomyces cerevisiae* Gal4, that contains a binuclear zinc cluster in which two zinc ions are bound by six cysteine residues (PFAM00172). Clr-1 polypeptides of the present disclosure, and homologs thereof, contain a "zinc(2)-cysteine(6) binuclear cluster domain" that includes the following conserved sequence: C-E-V-C-R-S-R-K-S-R-C-D-G-T-K-P-K-C-K-L-C-T-E-L-G-A-E-C-I-Y-R-E (SEQ ID NO: 235) (FIG. 21). Clr-2 polypeptides of the present disclosure, and homologs thereof, contain a "zinc(2)-cysteine(6) binuclear cluster domain" that includes the following conserved sequence: C-A-E-C-R-R-R-K-I-R-C-D-G-E-Q-PC-G-Q-C-X-W-Y-X-K-P-K-R-C-F-Y-R-V-X-P-S-R-K (SEQ ID NO: 236), where X can be any amino acid residue (FIG. 22).

As used herein, a "PFAM04082 transcription factor domain" refers to a fungal-specific transcription factor domain that is associated with a zinc finger or zinc binuclear transcription factor domain. Clr-1 polypeptides of the present disclosure, and homologs thereof, contain a "PFAM04082 transcription factor domain" that includes the following conserved sequence: I-E-A-Y-F-E-R-V-N-V-W-Y-A-C-V-N-P-Y-T-W-R-S-H-Y-R-T-A-L-S-N-G-F-R-E-G-P-E-S-C-I-V-L-L-V-L-A-L-G-Q-A-S-L-R-G-S-I-S-R-I-V-P-X-E-D-P-P-G-L-Q-Y-F-T-A-A-W-X-L-L-P-G-M-M-T-X-N-S-V-L-A-A-Q-C-H-L-L-A-A-A-Y-L-F-Y-L-V-R- P-L-E-A-W-N-L-L-C-T-T-S-T-K-L-Q-L-L-L-M-A-P-N-R-V-P-P-X-Q-R-E-L-S-E-R-I-Y-W-N-A-L-L-F-E-S-D-L-L-A-E-L-D-L-P-H-S-G-V-Q-F-E-E-N-V-G-L-P-G-G-F-E-G-E-E-D-E-X-D-E-E-A-D-X-D-Q-E-I-A-X-V-T-A-V-G-R-D-E-L-W-Y-F-L-A-E-I-A-L-R-R-L- L-N-R-V-S-Q-L-I-Y-S-K-D-T-P-Y-S-K-G-P-S-M-A-S-T-T-S-L-E-P-I-V-A-E-L-D-F-Q-L-T-Q-W-Y-E (SEQ ID NO: 237), where X can be any amino acid residue (FIG. 21). Clr-2 polypeptides of the present disclosure, and homologs thereof, contain a "PFAM04082 transcription factor domain" that includes the following conserved sequence: I-D-A-Y-F-K-R-V-H-X-F-X-P-M-L-D-E-X-T-F-R-A-T-Y-L-E-G-Q-R-K-D-A-P-W-L-A-L-L-N-M-V-F-A-L-G-S-I-A-A-M-K-S-D-D-Y-N-H-X-X-Y-Y-N-R-A-M-E-H-L-X-L-D-S-F-G-S-S-H-X-E-T-V-Q-A-L-A-L-M-G-G-Y-Y-L-H-Y-I- N-R-P-N-X-A-N-A-L-M-G-A-A-L-R-M-A-S-A-L-G-L-H-R-E-S-L-A-Q-X-X-A-S-S-Q-K-G-V-N-X-S-D-X-A-S-A-E-T-R-R-R-T-W-W-S-L-F-C-L-D-T-W-A-T-T-T-L-G-R-P-S-X-G-R-W-G (SEQ ID NO: 238), where X can be any amino acid residue (FIG. 22).

Accordingly, in certain embodiments, clr-1 polypeptides of the present disclosure have a zinc(2)-cysteine(6)

binuclear cluster domain having the following conserved sequence: C-E-V-C-R-S-R-K-S-R-C-D-G-T-K-P-K-C-K-L-C-T-E-L-G-A-E-C-I-Y-R-E (SEQ ID NO: 235); and a PFAM04082 transcription factor domain having the following conserved sequence: I-E-A-Y-F-E-R-V-N-V-W-Y-A-C-V-N-P-Y-T-W-R-S-H-Y-R-T-A-L-S-N-G-F-R-E-G-P-E-S-C-I-V-L-L-V-L-A-L-G-Q-A-S-L-R-G-S-I-S-R-I-V-P-X-E-D-P- P-G-L-Q-Y-F-T-A-A-W-X-L-L-P-G-M-M-T-X-N-S-V-L-A-A-Q-C-H-L-L-A-A-A-Y-L-F-Y-L-V-R-P-L-E-A-W-N-L-L-C-T-T-S-T-K-L-Q-L-L-L-M-A-P-N-R-V-P-P-X-Q-R-E-L-S-E-R-I-Y-W-N-A-L-L-F-E-S-D-L-L-A-E-L-D-L-P-H-S-G-I-V-Q-F-E-E-N-V-G-L-P-G-G- F-E-G-E-E-D-E-X-D-E-E-A-D-X-D-Q-E-I-A-X-V-T-A-V-G-R-D-E-L-W-Y-F-L-A-E-A-L-R-R-L-L-N-R-V-S-Q-L-I-Y-S-K-D-T-P-Y-S-K-G-P-S-M-A-S-T-T-S-L-E-P-I-V-A-E-L-D-F-Q-L-T-Q-W-Y-E (SEQ ID NO: 237).

Clr-1 polypeptides of the present disclosure include, without limitation, the polypeptide sequences of NCU07705 (SEQ ID NO: 1), XP_755084.1 (SEQ ID NO: 23), AN5808 (SEQ ID NO: 24), CAK44822.1 (SEQ ID NO: 25), BAE65369.1 (SEQ ID NO: 26), XP_001555641.1 (SEQ ID NO: 27), XP_001223845.1 (SEQ ID NO: 28), XP_385244.1 (SEQ ID NO: 29), EFQ33187.1 (SEQ ID NO: 30), EFX05743.1 (SEQ ID NO: 31), CBY01925.1 (SEQ ID NO: 32), XP_363808.2 (SEQ ID NO: 33), XP_003046557.1 (SEQ ID NO: 34), NCU00808 (SEQ ID NO: 35), XP_002561618.1 (SEQ ID NO: 36), XP_001793692.1 (SEQ ID NO: 37), XP_001910210.1 (SEQ ID NO: 38), XP_003302859.1 (SEQ ID NO: 39), XP_001941914.1 (SEQ ID NO: 40), XP_001586051.1 (SEQ ID NO: 41), XP_003349955.1 (SEQ ID NO: 42), SEQ ID NO: 43, XP_003009138.1 (SEQ ID NO: 44), XP_002147949.1 (SEQ ID NO: 45), XP_002481929.1 (SEQ ID NO: 46), EFY98315.1 (SEQ ID NO: 47), EGO59041.1 (SEQ ID NO: 48), XP_001267691.1 (SEQ ID NO: 15), XP_002378199.1 (SEQ ID NO: 16), CAK44822.1 (SEQ ID NO: 17), BAE65369.1 (SEQ ID NO: 18), XP_001209542.1 (SEQ ID NO: 19), EFY86844.1 (SEQ ID NO: 20), EGP86518.1 (SEQ ID NO: 21), XP_001260268.1 (SEQ ID NO: 22), and *Trichoderma reesei* clr-1 (SEQ ID NO: 182).

Clr-1 polypeptides of the present disclosure also include polypeptides that are homologs of clr-1 proteins identified herein. In some aspects, the present disclosure relates to polypeptides that are homologs of *N. crassa* clr-1, homologs of *Aspergillus nidulans* clrA, and/or homologs of *Trichoderma reesei* clr-1. Methods for identification of polypeptides that are homologs of a polypeptide of interest are well known to one of skill in the art, as described herein.

Clr-1 polypeptides of the present disclosure further include polypeptides containing an amino acid sequence having at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 98%, at least 99%, or 100% identity to the sequence of SEQ ID NO: 1, SEQ ID NO: 24, or SEQ ID NO: 182. Polypeptides of the disclosure also include polypeptides having at least 10, at least 12, at least 14, at least 16, at least 18, or at least 20 consecutive amino acids of SEQ ID NO: 1, SEQ ID NO: 24, or SEQ ID NO: 182.

A clr-1 polypeptide of the present disclosure includes, without limitation, clr-1 of *Neurospora crassa* (*N. crassa*), which has the gene name NCU07705 (SEQ ID NO: 1). The zinc(2)-cysteine(6) domain of *N. crassa* clr-1 corresponds to about amino acids 134-166 of SEQ ID NO: 1. The conserved central domain of *N. crassa* clr-1 corresponds to about amino acids 313-549 of SEQ ID NO: 1. The zinc(2)-cysteine (6) domain and conserved central domain of other clr-1 polypeptides may be determined by aligning a clr-1 sequence of interest to the amino acid sequence of *N. crassa* clr-1, and identifying the amino acids in a sequence of interest which align with amino acids 134-166 and 313-549 of SEQ ID NO: 1. Another clr-1 polypeptide of the present disclosure includes, without limitation, clrA of *Aspergillus nidulans*, which has the gene name AN5808 (SEQ ID NO: 24). A further clr-1 polypeptide of the present disclosure includes, without limitation, clr-1 of *Trichoderma reesei* (SEQ ID NO: 182).

Clr-1 Sequence Motifs

The amino acid sequences of *N. crassa* clr-1 and 22 clr-1 homologs were aligned with the MAFFT alignment algorithm, (CBRC mafft website) and alignments were manually inspected for regions of conservation outside of known conserved domains in likely orthologs, as determined by phylogenetic analysis. The analysis identified five conserved sequence motifs. The first conserved sequence is: A-G-D-[KR]-[LM]-I-[LI]-[ED]-[RKQH]-L-N-R-I-E-[SNG]-L-L (SEQ ID NO: 188). The second conserved sequence is: H-[HR]-[ADE]-G-H-[MLI]-P-Y-[IL]-[WF]-Q-G-A-L-S-[MI]-[VMI] (SEQ ID: 189). The third conserved sequence is: [NP]-[PS]-[LKTS]-K-[RK]-[RK]-[NSP]-[TSN]-[EDST]-X-X-[VIAT]-[DE]-Y-P (SEQ ID NO: 190), where X can be any amino acid residue. The fourth conserved sequence is: G-[GTSVN]-[FLI]-G-[TS]-W-[SNVAT]-[ANS]-[QTP]-[PA]-[TS] (SEQ ID NO: 191). The fifth conserved sequence is: R-[NH]-[LM]-[ST]-[QP]-[STP]-[SP]-[DE] (SEQ ID NO: 192). As an example of how to such motifs, the following motif, R-[NH]-[LM]-[ST]-[QP]-[STP]-[SP]-[DE] (SEQ ID NO: 192), is translated as: Arg-[Asn or His]-[Leu or Met]-[Ser or Thr]-[Gln or Pro]-[Ser, Thr, or Pro]-[Ser or Pro]-[Asp, or Glu] (SEQ ID NO: 192). These conserved motifs can be used to identify further clr-1 transcription factors.

Accordingly, in certain embodiments, clr-1 transcription factor proteins of the present disclosure contain a zinc(2)-cysteine(6) binuclear cluster domain, a PFAM04082 transcription factor domain, and at least one, at least two, at least three, at least four, or at least five polypeptide sequence selected from SEQ ID NOs: 188, 189, 190, 191, and 192.

Clr-2

In some aspects, the present disclosure relates to clr-2 polypeptides. Clr-2 polypeptides function as transcription factors that regulate the transcription of various genes in a fungal cell in response to the exposure of the cell to cellulose. In some aspects, the expression of a gene is increased in response to clr-2 expression. In some aspects, the expression of a gene is decreased in response to clr-2 expression.

Clr-2 is a member of the fungal specific zinc binuclear cluster superfamily, which is large, diverse superfamily of fungal-specific transcriptional regulators. Examples of transcription factors in this superfamily include gal-4, ace-1, and xlnR (xyr-1) (Stricker A R, et al., App. Micro. Biotech., 78: 211-220 (2008)). Clr-1 is also a member of this superfamily.

Members of this polypeptide superfamily typically contain two conserved domains: A) a zinc(2)-cysteine(6) binuclear cluster domain, which coordinates binding of the polypeptide to the DNA, and B) a central domain, which roughly corresponds to what is known as the "middle homology region" (Campbell R N, Biochemical J., 414: 177-187, (2008)), a conserved domain in zinc finger transcription factors. In clr-2, the conserved central domain has the fungal-specific transcription factor domain PFAM04082.

In certain embodiments, clr-2 polypeptides of the present disclosure have a zinc(2)-cysteine(6) binuclear cluster domain having the following conserved sequence: C-A-E-C-R-R-R-K-I-R-C-D-G-E-Q-PC-G-Q-C-X-W-Y-X-K-P-K-R-C-F-Y-R-V-X-P-S-R-K (SEQ ID NO: 236); and a PFAM04082 transcription factor domain having the following conserved sequence: I-D-A-Y-F-K-R-V-H-X-F-X-P-M-L-D-E-X-T-F-R-A-T-Y-L-E-G-Q-R-K-D-A-P-W-L-A-L-L-N-M-V-F-A-L-G-S-A-A-M-K-S-D-D-Y-N-H-X-X-Y-Y-N-R-A-M-E- H-L-X-L-D-S-F-G-S-S-H-X-E-T-V-Q-A-L-A-L-M-G-G-Y-Y-L-H-Y-I-N-R-P-N-X-A-N-A-L-M-G-A-A-L-R-M-A-S-A-L-G-L-H-R-E-S-L-A-Q-X-A-S-S-Q-K-G-V-N-X-S-D-X-A-S-A-E-T-R-R-R-T-W-W-S-L-F-C-L-D-T-W-A-T-T-T-L-G-R-P-S-X-G-R-W-G (SEQ ID NO: 238).

Clr-2 polypeptides of the present disclosure include the polypeptide sequences of NCU08042 (SEQ ID NO: 4), CAE85541.1 (SEQ ID NO: 69), XP_003347695.1 (SEQ ID NO: 70), XP_001910304.1 (SEQ ID NO: 71), XP_001223809.1 (SEQ ID NO: 72), EFQ33148.1 (SEQ ID NO: 73), XP_363907.1 (SEQ ID NO: 74), XP_003006605.1 (SEQ ID NO: 75), XP_003039508.1 (SEQ ID NO: 76), XP_001558061.1 (SEQ ID NO: 77), XP_003299229.1 (SEQ ID NO: 78), CBX99480.1 (SEQ ID NO: 79), XP_001395273.2 (SEQ ID NO: 80), XP_384856.1 (SEQ ID NO: 81), XP_003191005.1 (SEQ ID NO: 82), XP_002568399.1 (SEQ ID NO: 83), EDP48079.1 (SEQ ID NO: 84), AN3369 (SEQ ID NO: 85), XP_003065241.1 (SEQ ID NO: 86), XP_001240945.1 (SEQ ID NO: 87), XP_002542864.1 (SEQ ID NO: 88), XP_002480618.1 (SEQ ID NO: 89), XP_001940688.1 (SEQ ID NO: 90), XP_002151678.1 (SEQ ID NO: 91), EFY98873.1 (SEQ ID NO: 92), XP_001590666.1 (SEQ ID NO: 93), EGR49862 (SEQ ID NO: 94), XP_961763.2 (SEQ ID NO: 95), EGO59545.1 (SEQ ID NO: 96), SEQ ID NO: 97, CAK48469.1 (SEQ ID NO: 49), EFW15774.1 (SEQ ID NO: 50), XP_003040361.1 (SEQ ID NO: 51), XP_002561020.1 (SEQ ID NO: 52), XP_003009097.1 (SEQ ID NO: 53), XP_003001732.1 (SEQ ID NO: 54), XP_001272415.1 (SEQ ID NO: 55), XP_001268264.1 (SEQ ID NO: 56), XP_002384489.1 (SEQ ID NO: 57), XP_001217271.1 (SEQ ID NO: 58), XP_001214698.1 (SEQ ID NO: 59), XP_001218515.1 (SEQ ID NO: 60), EGP89821.1 (SEQ ID NO: 61), XP_001262768.1 (SEQ ID NO: 62), XP_001258355.1 (SEQ ID NO: 63), EDP49780.1 (SEQ ID NO: 64), XP_746801.1 (SEQ ID NO: 65), XP_751092.1 (SEQ ID NO: 66), AN6832 (SEQ ID NO: 67), and EFQ30604.1 (SEQ ID NO: 68).

Clr-2 polypeptides of the present disclosure also include polypeptides that are homologs of clr-2 proteins identified herein. In some aspects, the present disclosure relates to polypeptides that are homologs of N. crassa clr-2 and/or homologs of Aspergillus nidulans clrB. Methods for identification of polypeptides that are homologs of a polypeptide of interest are well known to one of skill in the art, as described herein.

Clr-2 polypeptides of the present disclosure further include polypeptides containing an amino acid sequence having at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 98%, at least 99%, or 100% identity to the sequence of SEQ ID NO: 4 or SEQ ID NO: 85. Polypeptides of the disclosure also include polypeptides having at least 10, at least 12, at least 14, at least 16, at least 18, or at least 20 consecutive amino acids of SEQ ID NO: 4 or SEQ ID NO: 85.

A clr-2 polypeptide of the present disclosure includes, without limitation, clr-2 of N. crassa, which has the gene name NCU08042 (SEQ ID NO: 4). The zinc(2)-cysteine(6) domain of N. crassa clr-2 corresponds to about amino acids 48-86 of SEQ ID NO: 4. The conserved central domain of N. crassa clr-2 corresponds to about amino acids 271-427 of SEQ ID NO: 4. The zinc(2)-cysteine(6) domain and conserved central domain of other clr-2 polypeptides may be determined by aligning a clr-2 sequence of interest to the sequence of N. crassa clr-2, and identifying the amino acids in a sequence of interest which align with amino acids 48-86 and 271-427 of SEQ ID NO: 4. Another clr-2 polypeptide of the present disclosure includes, without limitation, clrB of Aspergillus nidulans, which has the gene name AN3369 (SEQ ID NO: 85).

Clr-2 Sequence Motifs

The amino acid sequences of N. crassa clr-2 and 21 clr-2 homologs were aligned with the MAFFT alignment algorithm, (CBRC mafft website) and alignments were manually inspected for regions of conservation outside of known conserved domains in likely orthologs, as determined by phylogenetic analysis. The analysis identified five conserved sequence motifs. The analysis identified four conserved sequence motifs. The first conserved sequence is: [VL]-[ED]-[KAE]-L-S-[QTSN]-[STN]-[LVI]-[DE]-[DE]-[YC]-[RK]-[STV] (SEQ ID NO: 184). The second conserved sequence is: [MLI]-[STI]-G-W-N-A-V-W-[FLW]-[IVLCT]-[FY]-Q-[AS]-X-[ML]-[VI]-P-L-[ILV] (SEQ ID: 185), where X can be any amino acid residue. The third conserved sequence is: [ED]-X-L-[AV]-[AVI]-[STAL] (SEQ ID NO: 186), where X can be any amino acid residue. The fourth conserved sequence is: M-[FY]-[HIL]-T-F-[QE] (SEQ ID NO: 187). As an example of how to such motifs, the following motif, M-[FY]-[HIL]-T-F-[QE](SEQ ID NO: 187), is translated as: Met-[Phe or Tyr]-[His, Ile, or Leu]-Thr-Phe-[Gln or Glu]. These conserved motifs can be used to identify further clr-2 transcription factors.

Accordingly, in certain embodiments, clr-2 transcription factor proteins of the present disclosure contain a zinc(2)-cysteine(6) binuclear cluster domain, a PFAM04082 transcription factor domain, and at least one, at least two, at least three, or at least four polypeptide sequence selected from SEQ ID NOs: 184, 185, 186, and 187.

Genes Under Regulatory Control of Clr-1 and Clr-2

Clr-1 and clr-2 function as transcription factors for genes involved in the detection and metabolic response of a cell to the presence of cellulose. In some aspects, clr-1 and clr-2 are involved in the regulation of genes encoding cellulases. In some aspects, clr-1 and clr-2 are involved in the regulation of genes encoding polysaccharide active enzymes. In some aspects, clr-1 and clr-2 are involved in the regulation of genes encoding transport proteins. In some aspects, clr-1 and clr-2 are involved in the regulation of genes encoding proteins involved in protein synthesis and/or secretion. In some aspects, clr-1 and clr-2 are involved in the regulation of genes encoding hemicellulases. Genes under the regulatory control of clr-1 and/or clr-2 are further described in Table 1A-1E. In some aspects, the expression of a gene under the control of clr-1 and/or clr-2 is increased in response to clr-1 and/or clr-2 expression. In some aspects, the expression of a gene under the control of clr-1 and/or clr-2 is decreased in response to clr-1 and/or clr-2 expression.

Advantageously, mis-expression of clr-2 in a filamentous fungal cell induces expression of one or more cellulase genes under non-inducing or starvation conditions, resulting in increased secretion of one or more cellulases from the cell. For example, the non-inducing or starvation conditions may include, without limitation, culturing the filamentous fungal cell in the absence of any easily usable carbon source, such as cellulose or cellobiose; and culturing the filamentous fungal cell in the presence of a preferred carbon source, such as sucrose.

As used herein, "mis-expression" of a gene refers to expression of a gene under conditions where the gene is not normally expressed, such as under non-inducing conditions. Mis-expression may include, without limitation, recombinant expression, constitutive expression, inducible expression, heterologous expression, and over-expression.

Polynucleotides of the Disclosure

The present disclosure further relates to polynucleotides that encode clr-1 and clr-2 polypeptides. Polynucleotides that encode a polypeptide are also referred to herein as "genes". Methods for determining the relationship between a polypeptide and a polynucleotide that encodes the polypeptide are well known to one of skill in the art. Similarly, methods of determining the polypeptide sequence encoded by a polynucleotide sequence are well known to one of skill in the art.

As used herein, the terms "polynucleotide", "nucleic acid sequence", "nucleic acid", and variations thereof shall be generic to polydeoxyribonucleotides (containing 2-deoxy-D-ribose), to polyribonucleotides (containing D-ribose), to any other type of polynucleotide that is an N-glycoside of a purine or pyrimidine base, and to other polymers containing non-nucleotidic backbones, provided that the polymers contain nucleobases in a configuration that allows for base pairing and base stacking, as found in DNA and RNA. Thus, these terms include known types of nucleic acid sequence modifications, for example, substitution of one or more of the naturally occurring nucleotides with an analog, and inter-nucleotide modifications. As used herein, the symbols for nucleotides and polynucleotides are those recommended by the IUPAC-IUB Commission of Biochemical Nomenclature.

Clr-1

The present disclosure relates to polynucleotides that encode a clr-1 polypeptide. In some aspects, the disclosure relates to polynucleotides that encode the polypeptides of NCU07705 (SEQ ID NO: 1), XP_755084.1 (SEQ ID NO: 23), AN5808 (SEQ ID NO: 24), CAK44822.1 (SEQ ID NO: 25), BAE65369.1 (SEQ ID NO: 26), XP_001555641.1 (SEQ ID NO: 27), XP_001223845.1 (SEQ ID NO: 28), XP_385244.1 (SEQ ID NO: 29), EFQ33187.1 (SEQ ID NO: 30), EFX05743.1 (SEQ ID NO: 31), CBY01925.1 (SEQ ID NO: 32), XP_363808.2 (SEQ ID NO: 33), XP_003046557.1 (SEQ ID NO: 34), NCU00808 (SEQ ID NO: 35), XP_002561618.1 (SEQ ID NO: 36), XP_001793692.1 (SEQ ID NO: 37), XP_001910210.1 (SEQ ID NO: 38), XP_003302859.1 (SEQ ID NO: 39), XP_001941914.1 (SEQ ID NO: 40), XP_001586051.1 (SEQ ID NO: 41), XP_003349955.1 (SEQ ID NO: 42), SEQ ID NO: 43, XP_003009138.1 (SEQ ID NO: 44), XP_002147949.1 (SEQ ID NO: 45), XP_002481929.1 (SEQ ID NO: 46), EFY98315.1 (SEQ ID NO: 47), EGO59041.1 (SEQ ID NO: 48), XP_001267691.1 (SEQ ID NO: 15), XP_002378199.1 (SEQ ID NO: 16), CAK44822.1 (SEQ ID NO: 17), BAE65369.1 (SEQ ID NO: 18), XP_001209542.1 (SEQ ID NO: 19), EFY86844.1 (SEQ ID NO: 20), EGP86518.1 (SEQ ID NO: 21), XP_001260268.1 (SEQ ID NO: 22), and *Trichoderma reesei* clr-1 (SEQ ID NO: 182).

In some aspects, a polynucleotide of the disclosure is a polynucleotide that encodes the *N. crassa* clr-1 polypeptide. An example of a polynucleotide that encodes the *N. crassa* clr-1 polypeptide is SEQ ID NO: 2. In other aspects, a polynucleotide of the disclosure is a polynucleotide that encodes the *Aspergillus nidulans* clrA polypeptide. An example of a polynucleotide that encodes the *Aspergillus nidulans* clrA polypeptide is SEQ ID NO: 119. In further aspects, a polynucleotide of the disclosure is a polynucleotide that encodes the *Trichoderma reesei* clr-1 polypeptide. An example of a polynucleotide that encodes the *Trichoderma reesei* clr-1 polypeptide is SEQ ID NO: 183.

Polynucleotides of the disclosure also include polynucleotides having at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 98%, at least 99%, or 100% identity to the sequence of SEQ ID NO: 2, SEQ ID NO: 119, or SEQ ID NO: 183. Polynucleotides of the disclosure also include polynucleotides that have at least 10, at least 12, at least 14, at least 16, at least 18, at least 20, at least 22, at least 24, at least 26, at least 28, or at least 30 consecutive nucleotides of SEQ ID NO: 2, SEQ ID NO: 119, or SEQ ID NO: 183.

Polynucleotides of the disclosure further include fragments of polynucleotides that encode clr-1 polypeptides, polynucleotides that are complementary to polynucleotides that encode clr-1 polypeptides, and fragments of polynucleotides that are complementary to polynucleotides that encode clr-1 polypeptides.

Polynucleotides of the disclosure also include polynucleotides that encode polypeptides containing an amino acid sequence having at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 98%, at least 99%, or 100% identity to the sequence of SEQ ID NO: 1, SEQ ID NO: 24, or SEQ ID NO: 182. Polynucleotides of the disclosure also include polynucleotides that encode polypeptides having at least 10, at least 12, at least 14, at least 16, at least 18, or at least 20 consecutive amino acids of SEQ ID NO: 1, SEQ ID NO: 24, or SEQ ID NO: 182.

Polynucleotides of the disclosure that encode a clr-1 polypeptide also include polynucleotides having at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 98%, at least 99%, or 100% identity to any of the sequences of SEQ ID NOs: 98-132. Polynucleotides of the disclosure also include polynucleotides that have at least 10, at least 12, at least 14, at least 16, at least 18, at least 20, at least 22, at least 24, at least 26, at least 28, or at least 30 consecutive nucleotides of any of the sequences of SEQ ID NOs: 98-132.

Clr-2

The present disclosure relates to polynucleotides that encode a clr-2 polypeptide. In some aspects, the disclosure relates to polynucleotides that encode the polypeptides of NCU08042 (SEQ ID NO: 4), CAE85541.1 (SEQ ID NO: 69), XP_003347695.1 (SEQ ID NO: 70), XP_001910304.1 (SEQ ID NO: 71), XP_001223809.1 (SEQ ID NO: 72), EFQ33148.1 (SEQ ID NO: 73), XP_363907.1 (SEQ ID NO: 74), XP_003006605.1 (SEQ ID NO: 75), XP_003039508.1 (SEQ ID NO: 76), XP_001558061.1 (SEQ ID NO: 77), XP_003299229.1 (SEQ ID NO: 78), CBX99480.1 (SEQ ID NO: 79), XP_001395273.2 (SEQ ID NO: 80), XP_384856.1 (SEQ ID NO: 81), XP_003191005.1 (SEQ ID NO: 82), XP_002568399.1 (SEQ ID NO: 83), EDP48079.1 (SEQ ID NO: 84), AN3369 (SEQ ID NO: 85), XP_003065241.1

(SEQ ID NO: 86), XP_001240945.1 (SEQ ID NO: 87), XP_002542864.1 (SEQ ID NO: 88), XP_002480618.1 (SEQ ID NO: 89), XP_001940688.1 (SEQ ID NO: 90), XP_002151678.1 (SEQ ID NO: 91), EFY98873.1 (SEQ ID NO: 92), XP_001590666.1 (SEQ ID NO: 93), EGR49862 (SEQ ID NO: 94), XP_961763.2 (SEQ ID NO: 95), EGO59545.1 (SEQ ID NO: 96), SEQ ID NO: 97, CAK48469.1 (SEQ ID NO: 49), EFW15774.1 (SEQ ID NO: 50), XP_003040361.1 (SEQ ID NO: 51), XP_002561020.1 (SEQ ID NO: 52), XP_003009097.1 (SEQ ID NO: 53), XP_003001732.1 (SEQ ID NO: 54), XP_001272415.1 (SEQ ID NO: 55), XP_001268264.1 (SEQ ID NO: 56), XP_002384489.1 (SEQ ID NO: 57), XP_001217271.1 (SEQ ID NO: 58), XP_001214698.1 (SEQ ID NO: 59), XP_001218515.1 (SEQ ID NO: 60), EGP89821.1 (SEQ ID NO: 61), XP_001262768.1 (SEQ ID NO: 62), XP_001258355.1 (SEQ ID NO: 63), EDP49780.1 (SEQ ID NO: 64), XP_746801.1 (SEQ ID NO: 65), XP_751092.1 (SEQ ID NO: 66), AN6832 (SEQ ID NO: 67), and EFQ30604.1 (SEQ ID NO: 68).

In some aspects, a polynucleotide of the disclosure is a polynucleotide that encodes the *N. crassa* clr-2 polypeptide. An example of polynucleotide that encodes the *N. crassa* clr-2 polypeptide is SEQ ID NO: 5. In other aspects, a polynucleotide of the disclosure is a polynucleotide that encodes the *Aspergillus nidulans* clrB polypeptide. An example of a polynucleotide that encodes the *Aspergillus nidulans* clrB polypeptide is SEQ ID NO: 165.

Polynucleotides of the disclosure also include polynucleotides having at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 98%, at least 99%, or 100% identity to the sequence of SEQ ID NO: 5 or SEQ ID NO: 165. Polynucleotides of the disclosure also include polynucleotides that have at least 10, at least 12, at least 14, at least 16, at least 18, at least 20, at least 22, at least 24, at least 26, at least 28, or at least 30 consecutive nucleotides of SEQ ID NO: 5 or SEQ ID NO: 165.

Polynucleotides of the disclosure further include fragments of polynucleotides that encode clr-2 polypeptides, polynucleotides that are complementary to polynucleotides that encode clr-2 polypeptides, and fragments of polynucleotides that are complementary to polynucleotides that encode clr-2 polypeptides.

Polynucleotides of the disclosure also include polynucleotides that encode polypeptides containing an amino acid sequence having at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 98%, at least 99%, or 100% identity to the sequence of SEQ ID NO: 4 or SEQ ID NO: 85. Polynucleotides of the disclosure also include polynucleotides that encode polypeptides having at least 10, at least 12, at least 14, at least 16, at least 18, or at least 20 consecutive amino acids of SEQ ID NO: 4 or SEQ ID NO: 85.

Polynucleotides of the disclosure that encode a clr-2 polypeptide also include polynucleotides having at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 98%, at least 99%, or 100% identity to any of the sequences of SEQ ID NOs: 133-181. Polynucleotides of the disclosure also include polynucleotides that have at least 10, at least 12, at least 14, at least 16, at least 18, at least 20, at least 22, at least 24, at least 26, at least 28, or at least 30 consecutive nucleotides of any of the sequences of SEQ ID NOs: 133-181.

Sequence Homologs

As used herein, "homologs" are polypeptide or polynucleotide sequences that share a significant degree of sequence identity or similarity. Sequences that are homologs are referred to as being "homologous" to each other. Homologs include sequences that are orthologs or paralogs.

As used herein, "orthologs" are evolutionarily related polypeptide or polynucleotide sequences in different species that have similar sequences and functions, and that develop through a speciation event. Sequences that are orthologs are referred to as being "orthologous" to each other.

As used herein, "paralogs" are evolutionarily related polypeptide or polynucleotide sequences in the same organism that have similar sequences and functions, and that develop through a gene duplication event. Sequences that are paralogs are referred to as being "paralogous" to each other.

Methods of Identification of Homologous Sequences/Sequence Identity and Similarity Several different methods are known to those of skill in the art for identifying homologous sequences, including phylogenetic methods, sequence similarity analysis, and hybridization methods.

Phylogenetic Methods

Phylogenetic trees may be created for a gene family by using a program such as CLUSTAL (Thompson et al. *Nucleic Acids Res.* 22: 4673-4680 (1994); Higgins et al. *Methods Enzymol* 266: 383-402 (1996)) or MEGA (Tamura et al. *Mol. Biol. & Evo.* 24:1596-1599 (2007)). Once an initial tree for genes from one species is created, potential orthologous sequences can be placed in the phylogenetic tree and their relationships to genes from the species of interest can be determined. Evolutionary relationships may also be inferred using the Neighbor-Joining method (Saitou and Nei, *Mol. Biol. & Evo.* 4:406-425 (1987)). Homologous sequences may also be identified by a reciprocal BLAST strategy. Evolutionary distances may be computed using the Poisson correction method (Zuckerkandl and Pauling, pp. 97-166 in *Evolving Genes and Proteins*, edited by V. Bryson and H. J. Vogel. Academic Press, New York (1965)).

In addition, evolutionary information may be used to predict gene function. Functional predictions of genes can be greatly improved by focusing on how genes became similar in sequence (i.e. by evolutionary processes) rather than on the sequence similarity itself (Eisen, *Genome Res.* 8: 163-167 (1998)). Many specific examples exist in which gene function has been shown to correlate well with gene phylogeny (Eisen, *Genome Res.* 8: 163-167 (1998)). By using a phylogenetic analysis, one skilled in the art would recognize that the ability to deduce similar functions conferred by closely-related polypeptides is predictable.

When a group of related sequences are analyzed using a phylogenetic program such as CLUSTAL, closely related sequences typically cluster together or in the same clade (a group of similar genes). Groups of similar genes can also be identified with pair-wise BLAST analysis (Feng and Doolittle, *J. Mol. Evol.* 25: 351-360 (1987)). Analysis of groups of similar genes with similar function that fall within one clade can yield sub-sequences that are particular to the clade. These sub-sequences, known as consensus sequences, can not only be used to define the sequences within each clade, but define the functions of these genes; genes within a clade may contain paralogous sequences, or orthologous sequences that share the same function (see also, for example, Mount, Bioinformatics: Sequence and Genome Analysis Cold Spring Harbor Laboratory Press, Cold Spring Harbor, N.Y., page 543 (2001)).

To find sequences that are homologous to a reference sequence, BLAST nucleotide searches can be performed with the BLASTN program, score=100, wordlength=12, to obtain nucleotide sequences homologous to a nucleotide sequence encoding a protein of the disclosure. BLAST protein searches can be performed with the BLASTX program, score=50, wordlength=3, to obtain amino acid sequences homologous to a protein or polypeptide of the disclosure. To obtain gapped alignments for comparison purposes, Gapped BLAST (in BLAST 2.0) can be utilized as described in Altschul et al. (1997) Nucleic Acids Res. 25:3389. Alternatively, PSI-BLAST (in BLAST 2.0) can be used to perform an iterated search that detects distant relationships between molecules. See Altschul et al. (1997) supra. When utilizing BLAST, Gapped BLAST, or PSI-BLAST, the default parameters of the respective programs (e.g., BLASTN for nucleotide sequences, BLASTX for proteins) can be used.

Sequence Alignment/Sequence Similarity and Identity Analysis

Methods for the alignment of sequences and for the analysis of similarity and identity of polypeptide and polynucleotide sequences are well known in the art.

As used herein "sequence identity" refers to the percentage of residues that are identical in the same positions in the sequences being analyzed. As used herein "sequence similarity" refers to the percentage of residues that have similar biophysical/biochemical characteristics in the same positions (e.g. charge, size, hydrophobicity) in the sequences being analyzed.

Methods of alignment of sequences for comparison are well-known in the art, including manual alignment and computer assisted sequence alignment and analysis. This latter approach is a preferred approach in the present disclosure, due to the increased throughput afforded by computer assisted methods. As noted below, a variety of computer programs for performing sequence alignment are available, or can be produced by one of skill.

The determination of percent sequence identity and/or similarity between any two sequences can be accomplished using a mathematical algorithm. Non-limiting examples of such mathematical algorithms are the algorithm of Myers and Miller, CABIOS 4:11-17 (1988); the local homology algorithm of Smith et al., Adv. Appl. Math. 2:482 (1981); the homology alignment algorithm of Needleman and Wunsch, J. Mol. Biol. 48:443-453 (1970); the search-for-similarity-method of Pearson and Lipman, Proc. Natl. Acad. Sci. 85:2444-2448 (1988); the algorithm of Karlin and Altschul, Proc. Natl. Acad. Sci. USA 87:2264-2268 (1990), modified as in Karlin and Altschul, Proc. Natl. Acad. Sci. USA 90:5873-5877 (1993).

Computer implementations of these mathematical algorithms can be utilized for comparison of sequences to determine sequence identity and/or similarity. Such implementations include, but are not limited to: CLUSTAL in the PC/Gene program (available from Intelligenetics, Mountain View, Calif.); the AlignX program, version10.3.0 (Invitrogen, Carlsbad, Calif.) and GAP, BESTFIT, BLAST, FASTA, and TFASTA in the Wisconsin Genetics Software Package, Version 8 (available from Genetics Computer Group (GCG), 575 Science Drive, Madison, Wis., USA). Alignments using these programs can be performed using the default parameters. The CLUSTAL program is well described by Higgins et al. Gene 73:237-244 (1988); Higgins et al. CABIOS 5:151-153 (1989); Corpet et al., Nucleic Acids Res. 16:10881-90 (1988); Huang et al. CABIOS 8:155-65 (1992); and Pearson et al., Meth. Mol. Biol. 24:307-331 (1994). The BLAST programs of Altschul et al. J. Mol. Biol. 215:403-410 (1990) are based on the algorithm of Karlin and Altschul (1990) supra.

Hybridization Methods

Polynucleotides homologous to a reference sequence can be identified by hybridization to each other under stringent or under highly stringent conditions. Single stranded polynucleotides hybridize when they associate based on a variety of well characterized physical-chemical forces, such as hydrogen bonding, solvent exclusion, base stacking and the like. The stringency of a hybridization reflects the degree of sequence identity of the nucleic acids involved, such that the higher the stringency, the more similar are the two polynucleotide strands. Stringency is influenced by a variety of factors, including temperature, salt concentration and composition, organic and non-organic additives, solvents, etc. present in both the hybridization and wash solutions and incubations (and number thereof), as described in more detail in references cited below (e.g., Sambrook et al., Molecular Cloning: A Laboratory Manual, 2nd Ed., Vol. 1-3, Cold Spring Harbor Laboratory, Cold Spring Harbor, N.Y. ("Sambrook") (1989); Berger and Kimmel, Guide to Molecular Cloning Techniques, Methods in Enzymology, vol. 152 Academic Press, Inc., San Diego, Calif. ("Berger and Kimmel") (1987); and Anderson and Young, "Quantitative Filter Hybridisation." In: Hames and Higgins, ed., Nucleic Acid Hybridisation, A Practical Approach. Oxford, TRL Press, 73-111 (1985)).

Encompassed by the disclosure are polynucleotide sequences that are capable of hybridizing to the disclosed polynucleotide sequences, including any polynucleotide within the Sequence Listing, and fragments thereof under various conditions of stringency (see, for example, Wahl and Berger, Methods Enzymol. 152: 399-407 (1987); and Kimmel, Methods Enzymo. 152: 507-511, (1987)). In addition to the nucleotide sequences in the Sequence Listing, full length cDNA, orthologs, and paralogs of the present nucleotide sequences may be identified and isolated using well-known polynucleotide hybridization methods.

With regard to hybridization, conditions that are highly stringent, and means for achieving them, are well known in the art. See, for example, Sambrook et al. (1989) (supra); Berger and Kimmel (1987) pp. 467-469 (supra); and Anderson and Young (1985)(supra).

Hybridization experiments are generally conducted in a buffer of pH between 6.8 to 7.4, although the rate of hybridization is nearly independent of pH at ionic strengths likely to be used in the hybridization buffer (Anderson and Young (1985)(supra)). In addition, one or more of the following may be used to reduce non-specific hybridization: sonicated salmon sperm DNA or another non-complementary DNA, bovine serum albumin, sodium pyrophosphate, sodium dodecylsulfate (SDS), polyvinyl-pyrrolidone, ficoll and Denhardt's solution. Dextran sulfate and polyethylene glycol 6000 act to exclude DNA from solution, thus raising the effective probe DNA concentration and the hybridization signal within a given unit of time. In some instances, conditions of even greater stringency may be desirable or required to reduce non-specific and/or background hybridization. These conditions may be created with the use of higher temperature, lower ionic strength and higher concentration of a denaturing agent such as formamide.

Stringency conditions can be adjusted to screen for moderately similar fragments such as homologous sequences from distantly related organisms, or to highly similar fragments such as genes that duplicate functional enzymes from closely related organisms. The stringency can be adjusted either during the hybridization step or in the post-hybridization washes. Salt concentration, formamide concentration, hybridization temperature and probe lengths are variables that can be used to alter stringency. As a general guidelines high stringency is typically performed at $T_m-5°$ C. to $T_m-20°$ C., moderate stringency at $T_m-20°$ C. to $T_m-35°$ C. and low stringency at $T_m-35°$ C. to $T_m-50°$ C. for duplex >150 base pairs. Hybridization may be performed at low to moderate stringency (25-50° C. below $T_m$), followed by post-hybridization washes at increasing stringencies. Maximum rates of hybridization in solution are determined empirically to occur at $T_m-25°$ C. for DNA-DNA duplex and $T_m-15°$ C. for RNA-DNA duplex. Optionally, the degree of dissociation may be assessed after each wash step to determine the need for subsequent, higher stringency wash steps.

High stringency conditions may be used to select for nucleic acid sequences with high degrees of identity to the disclosed sequences. An example of stringent hybridization conditions obtained in a filter-based method such as a Southern or northern blot for hybridization of complementary nucleic acids that have more than 100 complementary residues is about 5° C. to 20° C. lower than the thermal melting point ($T_m$) for the specific sequence at a defined ionic strength and pH.

Hybridization and wash conditions that may be used to bind and remove polynucleotides with less than the desired homology to the nucleic acid sequences or their complements that encode the present transcription factors include, for example: 6×SSC and 1% SDS at 65° C.; 50% formamide, 4×SSC at 42° C.; 0.5×SSC to 2.0×SSC, 0.1% SDS at 50° C. to 65° C.; or 0.1×SSC to 2×SSC, 0.1% SDS at 50° C.-65° C.; with a first wash step of, for example, 10 minutes at about 42° C. with about 20% (v/v) formamide in 0.1× SSC, and with, for example, a subsequent wash step with 0.2×SSC and 0.1% SDS at 65° C. for 10, 20 or 30 minutes.

For identification of less closely related homologs, wash steps may be performed at a lower temperature, e.g., 50° C. An example of a low stringency wash step employs a solution and conditions of at least 25° C. in 30 mM NaCl, 3 mM trisodium citrate, and 0.1% SDS over 30 min. Greater stringency may be obtained at 42° C. in 15 mM NaCl, with 1.5 mM trisodium citrate, and 0.1% SDS over 30 min. Wash procedures will generally employ at least two final wash steps. Additional variations on these conditions will be readily apparent to those skilled in the art (see, for example, US Patent Application No. 20010010913).

If desired, one may employ wash steps of even greater stringency, including conditions of 65° C.-68° C. in a solution of 15 mM NaCl, 1.5 mM trisodium citrate, and 0.1% SDS, or about 0.2×SSC, 0.1% SDS at 65° C. and washing twice, each wash step of 10, 20 or 30 min in duration, or about 0.1×SSC, 0.1% SDS at 65° C. and washing twice for 10, 20 or 30 min. Hybridization stringency may be increased further by using the same conditions as in the hybridization steps, with the wash temperature raised about 3° C. to about 5° C., and stringency may be increased even further by using the same conditions except the wash temperature is raised about 6° C. to about 9° C.

Polynucleotide probes may be prepared with any suitable label, including a fluorescent label, a colorimetric label, a radioactive label, or the like. Labeled hybridization probes for detecting related polynucleotide sequences may be produced, for example, by oligolabeling, nick translation, end-labeling, or PCR amplification using a labeled nucleotide.

Host Cells of the Disclosure

The present disclosure further relates to host cells that contain a recombinant nucleic acid encoding a clr-1 polypeptide, clr-2 polypeptide, or clr-1 and clr-2 polypeptides.

"Host cell" and "host microorganism" are used interchangeably herein to refer to a living biological cell that can be transformed via insertion of recombinant DNA or RNA. Such recombinant DNA or RNA can be in an expression vector.

Any prokaryotic or eukaryotic host cell may be used in the present disclosure so long as it remains viable after being transformed with a sequence of nucleic acids. Preferably, the host cell is not adversely affected by the transduction of the necessary nucleic acid sequences, the subsequent expression of the proteins (e.g., transporters), or the resulting intermediates. Suitable eukaryotic cells include, but are not limited to, fungal, plant, insect or mammalian cells.

In some aspects, the host is a fungal strain. "Fungi" as used herein includes the phyla Ascomycota, Basidiomycota, Chytridiomycota, and Zygomycota as well as the Oomycota and all mitosporic fungi.

In some aspects, the host cell is fungus of the Ascomycota phylum. In some aspects, the host cell is of the genus *Metarhizium, Gibberella, Nectria, Magnaporthe, Neurospora, Sordaria, Chaetomium, Podospora, Verticillium, Glomerella, Grosmannia, Sclerotinia, Botryotinia, Aspergillus, Aspergillus, Penicillium, Leptosphaeria, Phaeosphaeria, Pyrenophora, Penicillium, Talaromyces, Trichoderma, Uncinocarpus, Coccidioidesi, Saccharomyces, Schizosaccharomyces, Sporotrichum (Myceliophthora), Thielevia, Acremonium, Yarrowia, Hansenula, Kluyveromyces, Pichia, Mycosphaerella, Neosartorya, Thermomyces (Humicola, Monotospora, Sepedonium)*, or *Chrysosporium*.

In other aspects, the host cell is of the species *Neurospora crassa, Metarhizium anisopliae, Metarhizium acridum, Gibberella zeae, Nectria haematococca, Magnaporthe oryzae, Neurospora tetrasperma, Sordaria macrospora, Chaetomium globosum, Podospora anserina, Verticillium alboatrum, Glomerella graminicola, Grosmannia clavigera, Sclerotinia sclerotiorum, Botryotinia fuckeliana, Aspergillus clavatus, Aspergillus flavus, Aspergillus oryzae, Aspergillus nidulans, Aspergillus niger, Aspergillus fumigatus, Aspergillus terreus, Penicillium chrysogenum, Leptosphaeria maculans, Phaeosphaeria nodorum, Pyrenophora tritici-repentis, Pyrenophora teres, Penicillium marneffei, Talaromyces stipitatus, Trichoderma reesei, Uncinocarpus reesii, Coccidioides immitis, Coccidioides posadasii, Saccharomyces cerevisiae, Schizosaccharomyces pombe, Sporotrichum thermophile (Myceliophthora thermophila), Thielavia terrestris-thermophilic, Acremonium cellulolyticus, Yarrowia lipolytica, Hansenula polymorpha, Kluyveromyces lactis, Pichia pastoris, Mycosphaerella graminicola, Neosartoryafischeri, Thermomyces lanuginosus (Humicola brevis, Humicola brevispora, Humicola grisea, Humicola lanuginosa, Monotospora lanuginosa, Sepedonium lanuginosum), Talaromyces thermophilus (Talaromyces dupontii, Penicillium dupontii)*, or *Chrysosporium lucknowense*.

The host cells of the present disclosure may be genetically modified in that recombinant nucleic acids have been introduced into the host cells, and as such the genetically modified host cells do not occur in nature. The suitable host cell is one capable of expressing one or more nucleic acid constructs encoding one or more proteins for different functions.

"Recombinant nucleic acid" or "heterologous nucleic acid" or "recombinant polynucleotide", "recombinant nucleotide" or "recombinant DNA" as used herein refers to a polymer of nucleic acids where at least one of the following is true: (a) the sequence of nucleic acids is foreign to (i.e., not naturally found in) a given host cell; (b) the sequence may be naturally found in a given host cell, but in an unnatural (e.g., greater than expected) amount; or (c) the sequence of nucleic acids contains two or more subsequences that are not found in the same relationship to each other in nature. For example, regarding instance (c), a recombinant nucleic acid sequence will have two or more sequences from unrelated genes arranged to make a new functional nucleic acid. Specifically, the present disclosure describes the introduction of an expression vector into a host cell, where the expression vector contains a nucleic acid sequence coding for a protein that is not normally found in a host cell or contains a nucleic acid coding for a protein that is normally found in a cell but is under the control of different regulatory sequences. With reference to the host cell's genome, then, the nucleic acid sequence that codes for the protein is recombinant. As used herein, the term "recombinant polypeptide" refers to a polypeptide generated from a "recombinant nucleic acid" or "heterologous nucleic acid" or "recombinant polynucleotide", "recombinant nucleotide" or "recombinant DNA" as described above.

In some aspects, the host cell naturally produces any of the proteins encoded by the polynucleotides of the disclosure. The genes encoding the desired proteins may be heterologous to the host cell or these genes may be endogenous to the host cell but are operatively linked to heterologous promoters and/or control regions that result in the higher expression of the gene(s) in the host cell.

Host Cell Components

In some aspects, host cells of the disclosure contain a recombinant nucleic acid encoding a clr-1 polypeptide and/or a recombinant nucleic acid encoding a clr-2 polypeptide. In certain embodiments, the recombinant nucleic acid encoding a clr-1 polypeptide and/or recombinant nucleic acid encoding a clr-2 polypeptide is mis-expressed in the host cell (e.g., constitutively expressed, inducibly expressed, etc.). In other embodiments, a host cell that contains a recombinant nucleic acid encoding a clr-1 polypeptide and/or a recombinant nucleic acid encoding a clr-2 polypeptide contains a greater amount of clr-1 polypeptide and/or clr-2 polypeptide than a corresponding host cell that does not contain a recombinant nucleic acid encoding a clr-1 polypeptide and/or a recombinant nucleic acid encoding a clr-2 polypeptide. When a protein or nucleic acid is produced or maintained in a host cell at an amount greater than normal, the protein or nucleic acid is "overexpressed". In some aspects, host cells of the disclosure overexpress clr-1 and/or clr-2. The present disclosure further is directed to cells that are modified and that have a greater level of clr-1 and/or clr-2 polypeptide than a corresponding cell that is not modified.

In some aspects, host cell of the disclosure contain a recombinant nucleic acid encoding a clr-2 transcription factor protein that contains a zinc(2)-cysteine(6) binuclear cluster domain, a PFAM04082 transcription factor domain, and at least one, at least two, at least three, or at least four polypeptide sequences selected from SEQ ID NOs: 184, 185, 186, and 187. In certain embodiments, the host cell may further contain at least one additional recombinant nucleic acid encoding a clr-1 transcription factor protein that contains a zinc(2)-cysteine(6) binuclear cluster domain, a PFAM04082 transcription factor domain, and at least one, at least two, at least three, at least four, or at least five polypeptide sequences selected from SEQ ID NOs: 188, 189, 190, 191, and 192.

In other aspects, host cell of the disclosure contain a recombinant nucleic acid encoding a clr-1 transcription factor protein that contains a zinc(2)-cysteine(6) binuclear cluster domain, a PFAM04082 transcription factor domain, and at least one, at least two, at least three, at least four, or at least five polypeptide sequences selected from SEQ ID NOs: 188, 189, 190, 191, and 192. In certain embodiments, the host cell may further contain at least one additional recombinant nucleic acid encoding a clr-2 transcription factor protein that contains a zinc(2)-cysteine(6) binuclear cluster domain, a PFAM04082 transcription factor domain, and at least one, at least two, at least three, or at least four polypeptide sequences selected from SEQ ID NOs: 184, 185, 186, and 187.

In some aspects, host cells of the disclosure contain a recombinant nucleic acid encoding a clr-1 polypeptide. In some aspects, host cells contain a recombinant nucleic acid encoding a clr-1 polypeptide having the amino acid sequence of any of: NCU07705 (SEQ ID NO: 1), XP_755084.1 (SEQ ID NO: 23), AN5808 (SEQ ID NO: 24), CAK44822.1 (SEQ ID NO: 25), BAE65369.1 (SEQ ID NO: 26), XP_001555641.1 (SEQ ID NO: 27), XP_001223845.1 (SEQ ID NO: 28), XP_385244.1 (SEQ ID NO: 29), EFQ33187.1 (SEQ ID NO: 30), EFX05743.1 (SEQ ID NO: 31), CBY01925.1 (SEQ ID NO: 32), XP_363808.2 (SEQ ID NO: 33), XP_003046557.1 (SEQ ID NO: 34), NCU00808 (SEQ ID NO: 35), XP_002561618.1 (SEQ ID NO: 36), XP_001793692.1 (SEQ ID NO: 37), XP_001910210.1 (SEQ ID NO: 38), XP_003302859.1 (SEQ ID NO: 39), XP_001941914.1 (SEQ ID NO: 40), XP_001586051.1 (SEQ ID NO: 41), XP_003349955.1 (SEQ ID NO: 42), SEQ ID NO: 43, XP_003009138.1 (SEQ ID NO: 44), XP_002147949.1 (SEQ ID NO: 45), XP_002481929.1 (SEQ ID NO: 46), EFY98315.1 (SEQ ID NO: 47), EGO59041.1 (SEQ ID NO: 48), XP_001267691.1 (SEQ ID NO: 15), XP_002378199.1 (SEQ ID NO: 16), CAK44822.1 (SEQ ID NO: 17), BAE65369.1 (SEQ ID NO: 18), XP_001209542.1 (SEQ ID NO: 19), EFY86844.1 (SEQ ID NO: 20), EGP86518.1 (SEQ ID NO: 21), XP_001260268.1 (SEQ ID NO: 22), or Trichoderma reesei clr-1 (SEQ ID NO: 182).

In some aspects, host cells contain a recombinant nucleic acid having the nucleic acid sequence of SEQ ID NO: 2, SEQ ID NO: 119, SEQ ID NO: 183, or any of SEQ ID NOs: 98-132.

In some aspects, host cells of the disclosure contain a recombinant nucleic acid encoding a clr-2 polypeptide. In some aspects, host cells contain a recombinant nucleic acid encoding a clr-2 polypeptide having the amino acid sequence of any of: NCU08042 (SEQ ID NO: 4), CAE85541.1 (SEQ ID NO: 69), XP_003347695.1 (SEQ ID NO: 70), XP_001910304.1 (SEQ ID NO: 71), XP_001223809.1 (SEQ ID NO: 72), EFQ33148.1 (SEQ ID NO: 73), XP_363907.1 (SEQ ID NO: 74), XP_003006605.1 (SEQ ID NO: 75), XP_003039508.1 (SEQ ID NO: 76), XP_001558061.1 (SEQ ID NO: 77), XP_003299229.1 (SEQ ID NO: 78), CBX99480.1 (SEQ ID NO: 79), XP_001395273.2 (SEQ ID NO: 80), XP_384856.1 (SEQ ID NO: 81), XP_003191005.1 (SEQ ID NO: 82), XP_002568399.1 (SEQ ID NO: 83), EDP48079.1 (SEQ ID NO: 84), AN3369 (SEQ ID NO: 85), XP_003065241.1 (SEQ ID NO: 86), XP_001240945.1 (SEQ ID NO: 87), XP_002542864.1 (SEQ ID NO: 88), XP_002480618.1 (SEQ ID NO: 89), XP_001940688.1 (SEQ ID NO: 90), XP_002151678.1 (SEQ ID NO: 91), EFY98873.1 (SEQ ID NO: 92), XP_001590666.1 (SEQ ID NO: 93), EGR49862 (SEQ ID NO: 94), XP_961763.2 (SEQ ID NO: 95), EGO59545.1 (SEQ ID NO: 96), SEQ ID NO: 97, CAK48469.1 (SEQ ID NO: 49), EFW15774.1 (SEQ ID NO: 50), XP_003040361.1 (SEQ ID NO: 51), XP_002561020.1 (SEQ ID NO: 52), XP_003009097.1 (SEQ ID NO: 53), XP_003001732.1 (SEQ ID NO: 54), XP_001272415.1 (SEQ ID NO: 55), XP_001268264.1 (SEQ ID NO: 56), XP_002384489.1 (SEQ ID NO: 57), XP_001217271.1 (SEQ ID NO: 58), XP_001214698.1 (SEQ ID NO: 59), XP_001218515.1 (SEQ ID NO: 60), EGP89821.1 (SEQ ID NO: 61), XP_001262768.1 (SEQ ID NO: 62), XP_001258355.1 (SEQ ID NO: 63), EDP49780.1 (SEQ ID NO: 64), XP_746801.1 (SEQ ID NO: 65), XP_751092.1 (SEQ ID NO: 66), AN6832 (SEQ ID NO: 67), or EFQ30604.1 (SEQ ID NO: 68).

In some aspects, host cells contain a recombinant nucleic acid having the nucleic acid sequence of SEQ ID NO: 5, SEQ ID NO: 165, or any of SEQ ID NOs: 133-181.

In some aspects, host cells of the current disclosure contain recombinant nucleic acids encoding a clr-1 polypeptide and a clr-2 polypeptide. In some aspects, host cells of the present disclosure contain recombinant nucleic acids encoding a clr-1 polypeptide having the amino acid sequence of SEQ ID NO: 1, SEQ ID NO: 24, or SEQ ID NO: 182, and a clr-2 polypeptide having the amino acid sequence of SEQ ID NO: 4 or SEQ ID NO: 85. In some aspects, host cells of the current disclosure contain recombinant nucleic acids having the nucleic acid sequences of SEQ ID NO: 2, SEQ ID NO: 119, or SEQ ID NO: 183, and SEQ ID NO: 5 or SEQ ID NO: 165.

Host cells of the disclosure may also be modified to reduce or inhibit expression of at least one gene involved in regulating protein secretion to increase secretion of proteins, such as cellulases. In some embodiments, the host cell is modified to reduce or inhibit expression of the catabolite repressor gene cre-1, or a homolog thereof. Techniques for modifying cells to reduce or inhibit expression of a gene are well known in the art and include, without limitation, those disclosed herein. Non-limiting examples include mutagenesis, RNAi, and antisense suppression.

Host cells of the disclosure may further contain one or more recombinant nucleic acid sequences encoding a hemicellulase. Hemicellulases include, without limitation, exoxylanases, endoxylanases, □-arabinofuranosidases, □-glucuronidases, □-xylosidases, and acetyl xylan esterases.

Host cells of the disclosure may further contain one or more recombinant nucleic acid sequences that encode a polypeptide in a biochemical pathway related to the production of a biofuel. In some aspects, a host cell contains a recombinant nucleic acid sequence encoding a polypeptide in a biochemical pathway involved in the production of ethanol, n-propanol, n-butanol, iso-butanol, 3-methyl-1-butanol, 2-methyl-1-butanol, 3-methyl-1-pentanol, and/or octanol.

Methods of Producing and Culturing Host Cells of the Disclosure

Methods of producing and culturing host cells of the disclosure may include the introduction or transfer of expression vectors containing the recombinant nucleic acids of the disclosure into the host cell. Such methods for transferring expression vectors into host cells are well known to those of ordinary skill in the art. For example, one method for transforming cells with an expression vector involves a calcium chloride treatment where the expression vector is introduced via a calcium precipitate. Other salts, e.g., calcium phosphate, may also be used following a similar procedure. In addition, electroporation (i.e., the application of current to increase the permeability of cells to nucleic acid sequences) may be used to transfect the host cell. Cells also may be transformed through the use of spheroplasts (Schweizer, M, Proc. Natl. Acad. Sci., 78: 5086-5090 (1981). Also, microinjection of the nucleic acid sequences provides the ability to transfect host cells. Other means, such as lipid complexes, liposomes, and dendrimers, may also be employed. Those of ordinary skill in the art can transfect a host cell with a desired sequence using these or other methods.

In some cases, cells are prepared as protoplasts or spheroplasts prior to transformation. Protoplasts or spheroplasts may be prepared, for example, by treating a cell having a cell wall with enzymes to degrade the cell wall. Fungal cells may be treated, for example, with chitinase.

The vector may be an autonomously replicating vector, i.e., a vector which exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the host, is integrated into the genome and replicated together with the chromosome(s) into which it has been integrated. Furthermore, a single vector or plasmid or two or more vectors or plasmids that together contain the total DNA to be introduced into the genome of the host, or a transposon may be used.

The vectors preferably contain one or more selectable markers which permit easy selection of transformed hosts. A selectable marker is a gene the product of which provides, for example, biocide or viral resistance, resistance to heavy metals, prototrophy to auxotrophs, and the like. Selection of bacterial cells may be based upon antimicrobial resistance that has been conferred by genes such as the amp, gpt, neo, and hyg genes.

Selectable markers for use in fungal host cells include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Suitable markers for S. cerevisiae hosts are, for example, ADE2, HIS3, LEU2, LYS2, MET3, TRP1, and URA3.

The vectors may contain an element(s) that permits integration of the vector into the host's genome or autonomous replication of the vector in the cell independent of the genome.

For integration into the host genome, the vector may rely on the gene's sequence or any other element of the vector for integration of the vector into the genome by homologous or nonhomologous recombination. Alternatively, the vector may contain additional nucleotide sequences for directing integration by homologous recombination into the genome of the host. The additional nucleotide sequences enable the vector to be integrated into the host genome at a precise location(s) in the chromosome(s). To increase the likelihood of integration at a precise location, the integrational elements should contain a sufficient number of nucleic acids, such as 100 to 10,000 base pairs, 400 to 10,000 base pairs, or 800 to 10,000 base pairs, which are highly homologous with the corresponding target sequence to enhance the probability of homologous recombination. The integrational elements may be any sequence that is homologous with the target sequence in the genome of the host. Furthermore, the integrational elements may be non-encoding or encoding nucleotide sequences. On the other hand, the vector may be integrated into the genome of the host by non-homologous recombination.

For autonomous replication, the vector may further contain an origin of replication enabling the vector to replicate autonomously in the host in question. The origin of replication may be any plasmid replicator mediating autonomous replication which functions in a cell. The term "origin of replication" or "plasmid replicator" is defined herein as a sequence that enables a plasmid or vector to replicate in vivo.

The vector may further contain a promoter for regulation of expression of a recombinant nucleic acid of the disclosure in the vector. Promoters for the regulation of expression of a gene are well-known in the art, and include constitutive promoters, and inducible promoters. Promoters are described, for example, in Sambrook, et al. Molecular Cloning: A Laboratory Manual, 3rd edition, Cold Spring Harbor Laboratory Press, (2001). Promoter can be viral, bacterial, fungal, mammalian, or plant promoters. Additionally, promoters can be constitutive promoters, inducible promoters, environmentally regulated promoters, or developmentally regulated promoters. Examples of suitable promoters for regulating recombinant nucleic acid of the disclosure, such as clr-1 and clr-2, include, without limitation, the *N. crassa* ccg-1 constitutive promoter, which is responsive to the *N. crassa* circadian rhythm and nutrient conditions; the *N. crassa* gpd-I (glyceraldehyde 3-phosphate dehydrogenase-1) strong constitutive promoter; the *N. crassa* vvd (light) inducible promoter; the *N. crassa* qa-2 (quinic acid) inducible promoter; the *Aspergillus nidulans* gpdA promoter; the *Aspergillus nidulans* trpC constitutive promoter, the *N. crassa* tef-I (transcription elongation factor) highly constitutive promoter; and the *N. crassa* xlr-1 (XlnR homolog) promoter, which is used frequently in *Aspergillus* species.

More than one copy of a gene may be inserted into the host to increase production of the gene product. An increase in the copy number of the gene can be obtained by integrating at least one additional copy of the gene into the host genome or by including an amplifiable selectable marker gene with the nucleotide sequence where cells containing amplified copies of the selectable marker gene, and thereby additional copies of the gene, can be selected for by cultivating the cells in the presence of the appropriate selectable agent.

The procedures used to ligate the elements described above to construct the recombinant expression vectors of the present invention are well known to one skilled in the art (see, e.g., Sambrook et al., 1989, supra).

The host cell is transformed with at least one expression vector. When only a single expression vector is used (without the addition of an intermediate), the vector will contain all of the nucleic acid sequences necessary.

Once the host cell has been transformed with the expression vector, the host cell is allowed to grow. Growth of a host cell in a medium may involve the process of fermentation. Methods of the disclosure may include culturing the host cell such that recombinant nucleic acids in the cell are expressed. Media, temperature ranges and other conditions suitable for growth are known in the art.

According to some aspects of the disclosure, the culture media contains a carbon source for the host cell. Such a "carbon source" generally refers to a substrate or compound suitable to be used as a source of carbon for cell growth. Carbon sources can be in various forms, including, but not limited to polymers, carbohydrates, acids, alcohols, aldehydes, ketones, amino acids, peptides, etc. These include, for example, various monosaccharides, oligosaccharides, polysaccharides, a biomass polymer such as cellulose or hemicellulose, xylose, arabinose, disaccharides, such as sucrose, saturated or unsaturated fatty acids, succinate, lactate, acetate, ethanol, etc., or mixtures thereof.

In addition to an appropriate carbon source, media must contain suitable minerals, salts, cofactors, buffers and other components, known to those skilled in the art, suitable for the growth of the cultures and promotion of the enzymatic pathways necessary for the fermentation of various sugars and the production of hydrocarbons and hydrocarbon derivatives. Reactions may be performed under aerobic or anaerobic conditions where aerobic, anoxic, or anaerobic conditions are preferred based on the requirements of the microorganism. As the host cell grows and/or multiplies, expression of the enzymes, transporters, or other proteins necessary for growth on various sugars or biomass polymers, sugar fermentation, or synthesis of hydrocarbons or hydrocarbon derivatives is affected.

Cells with Reduced Expression of Clr-1, Clr-2, Or Clr-1 and Clr-2

The present disclosure also relates to cells that naturally produce clr-1 and clr-2 polypeptides and cellulase enzymes ("cellulolytic cells"), which have a reduced level of expression of clr-1, clr-2, or clr-1 and clr-2. Cells that naturally produce cellulase enzymes and that have a reduced level of expression of clr-1, clr-2, or clr-1 and clr-2 may have reduced levels of expression or secretion of one or more cellulases. Without being bound by theory, cells that naturally produce cellulase enzymes which have a reduced level of expression of clr-1, clr-2, or clr-1 and clr-2 may have reduced levels of expression or secretion of one or more cellulases due to reduced activity of clr-1, clr-2 or clr-1 and clr-2 as transcription factors promoting the transcription of cellulase genes. The level of expression of a gene may be assessed by measuring the level of mRNA encoded by the gene, and/or by measuring the level or activity of the polypeptide encoded by the gene.

Furthermore, provided herein are methods of preparing cells which have a reduced level of expression clr-1, clr-2, or both clr-1 and clr-2. Reduction in gene expression may be achieved by any number of techniques well known in the art, including without limitation, mutagenesis, RNAi, and antisense suppression.

Mutagenesis

Mutagenesis approaches may be used to disrupt or "knockout" the expression of a target gene. In some aspects, the mutagenesis results in a partial deletion of the target gene. In other aspects, the mutagenesis results in a complete deletion of the target gene. Methods of mutagenizing microorganisms, such as cellulolytic cells, are well known in the art and include, without limitation random mutagenesis and site-directed mutagenesis. Examples of methods of random mutagenesis include, without limitation, chemical mutagenesis (e.g., using ethane methyl sulfonate), insertional mutagenesis, and irradiation.

One method for reducing or inhibiting the expression of a target gene is by genetically modifying the target gene and introducing it into the genome of a cellulolytic cell to replace the wild-type version of the gene by homologous recombination (for example, as described in U.S. Pat. No. 6,924, 146).

Another method for reducing or inhibiting the expression of a target gene is by insertion mutagenesis using the T-DNA of *Agrobacterium tumefaciens*, or transposons (see Winkler et al., Methods Mol. Biol. 82:129-136, 1989, and Martienssen Proc. Natl. Acad. Sci. 95:2021-2026, 1998). After generating the insertion mutants, the mutants can be screened to identify those containing the insertion in a target gene.

Other methods to disrupt a target gene include insertional mutagenesis (for example, as described in U.S. Pat. No. 5,792,633), and transposon mutagenesis (for example, as described in U.S. Pat. No. 6,207,384)

A further method to disrupt a target gene is by use of the cre-lox system (for example, as described in U.S. Pat. No. 4,959,317).

Another method to disrupt a target gene is by use of PCR mutagenesis (for example, as described in U.S. Pat. No. 7,501,275).

RNAi

Endogenous gene expression may also be reduced or inhibited by means of RNA interference (RNAi), which uses a double-stranded RNA having a sequence identical or similar to the sequence of the target gene. As used herein RNAi, includes the use of micro RNA, such as artificial miRNA to suppress expression of a gene.

RNAi is the phenomenon in which when a double-stranded RNA having a sequence identical or similar to that of the target gene is introduced into a cell, the expressions of both the inserted exogenous gene and target endogenous gene are suppressed. The double-stranded RNA may be formed from two separate complementary RNAs or may be a single RNA with internally complementary sequences that form a double-stranded RNA.

Thus, in some aspects, reduction or inhibition of gene expression is achieved using RNAi techniques. For example, to achieve reduction or inhibition of the expression of a DNA encoding a protein using RNAi, a double-stranded RNA having the sequence of a DNA encoding the protein, or a substantially similar sequence thereof (including those engineered not to translate the protein) or fragment thereof, is introduced into a cellulolytic cell of interest. As used herein, RNAi and dsRNA both refer to gene-specific silencing that is induced by the introduction of a double-stranded RNA molecule, see e.g., U.S. Pat. Nos. 6,506,559 and 6,573,099, and includes reference to a molecule that has a region that is double-stranded, e.g., a short hairpin RNA molecule. The resulting cellulolytic cells may then be screened for a phenotype associated with the reduced expression of the target gene, e.g., reduced cellulase expression, and/or by monitoring steady-state RNA levels for transcripts of the target gene. Although the sequences used for RNAi need not be completely identical to the target gene, they may be at least 70%, 80%, 90%, 91%, 92%, 93%, 94%, 95%, 96%, 97%, 98%, 99%, or more identical to the target gene sequence. See, e.g., U.S. Patent Application Publication No. 2004/0029283. The constructs encoding an RNA molecule with a stem-loop structure that is unrelated to the target gene and that is positioned distally to a sequence specific for the gene of interest may also be used to inhibit target gene expression. See, e.g., U.S. Patent Application Publication No. 2003/0221211.

The RNAi nucleic acids may encompass the full-length target RNA or may correspond to a fragment of the target RNA. In some cases, the fragment will have fewer than 100, 200, 300, 400, or 500 nucleotides corresponding to the target sequence. In addition, in some aspects, these fragments are at least, e.g., 50, 100, 150, 200, or more nucleotides in length. Interfering RNAs may be designed based on short duplexes (i.e., short regions of double-stranded sequences). Typically, the short duplex is at least about 15, 20, or 25-50 nucleotides in length (e.g., each complementary sequence of the double stranded RNA is 15-50 nucleotides in length), often about 20-30 nucleotides, e.g., 20, 21, 22, 23, 24, 25, 26, 27, 28, 29, or 30 nucleotides in length. In some cases, fragments for use in RNAi will correspond to regions of a target protein that do not occur in other proteins in the organism or that have little similarity to other transcripts in the organism, e.g., selected by comparison to sequences in analyzing publicly-available sequence databases. Similarly, RNAi fragments may be selected for similarity or identity with a conserved sequence of a gene family of interest, such as those described herein, so that the RNAi targets multiple different gene transcripts containing the conserved sequence.

RNAi may be introduced into a cellulolytic cell as part of a larger DNA construct. Often, such constructs allow stable expression of the RNAi in cells after introduction, e.g., by integration of the construct into the host genome. Thus, expression vectors that continually express RNAi in cells transfected with the vectors may be employed for this disclosure. For example, vectors that express small hairpin or stem-loop structure RNAs, or precursors to microRNA, which get processed in vivo into small RNAi molecules capable of carrying out gene-specific silencing (Brummelkamp et al, Science 296:550-553, (2002); and Paddison, et al., Genes & Dev. 16:948-958, (2002)) can be used. Post-transcriptional gene silencing by double-stranded RNA is discussed in further detail by Hammond et al., Nature Rev Gen 2: 110-119, (2001); Fire et al., Nature 391: 806-811, (1998); and Timmons and Fire, Nature 395: 854, (1998).

Methods for selection and design of sequences that generate RNAi are well known in the art (e.g. U.S. Pat. Nos. 6,506,559; 6,511,824; and 6,489,127).

In some aspects, RNAi sequences used herein correspond to a portion of SEQ ID NO: 2, SEQ ID NO: 119, SEQ ID NO: 183, SEQ ID NO: 5, or SEQ ID NO: 165. In some aspects, RNAi sequences used herein correspond to a portion of a nucleotide sequence having at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 98%, at least 99° %, or 100% identity to the sequence of SEQ ID NO: 2, SEQ ID NO: 119, SEQ ID NO: 183, SEQ ID NO: 5, or SEQ ID NO: 165. In some aspects, RNAi sequences used herein correspond to a portion of a nucleotide sequence having at least 10, at least 12, at least 14, at least 16, at least 18, at least 20, at least 22, at least 24, at least 26, at least 28, or at least 30 consecutive nucleotides of SEQ ID NO: 2, SEQ ID NO: 119, SEQ ID NO: 183, SEQ ID NO: 5, or SEQ ID NO: 165.

One of skill in the art will recognize that using technology based on specific nucleic acid sequences, families of homologous genes can be suppressed with a single transcript. For instance, if an antisense transcript is designed to have a sequence that is conserved among a family of genes, then multiple members of a gene family can be suppressed. Conversely, if the goal is to only suppress one member of a homologous gene family, then the transcript should be targeted to sequences with the most variation between family members.

The term "target gene" or "target sequences", refers to a gene targeted for reduced expression.

Antisense and Ribozyme Suppression

A reduction or inhibition of gene expression in a cellulolytic cell of a target gene may also be obtained by introducing into cellulolytic cells antisense constructs based on a target gene nucleic acid sequence. For antisense suppression, a target sequence is arranged in reverse orientation relative to the promoter sequence in the expression vector. The introduced sequence need not be a full length cDNA or gene, and need not be identical to the target cDNA or a gene found in the cellulolytic cell to be transformed. Generally, however, where the introduced sequence is of shorter length, a higher degree of homology to the native target sequence is used to achieve effective antisense suppression. In some aspects, the introduced antisense sequence in the vector will be at least 30 nucleotides in length, and improved antisense suppression will typically be observed as the length of the antisense sequence increases. In some aspects, the length of the antisense sequence in the vector will be greater than 100 nucleotides. Transcription of an antisense construct as described results in the production of RNA molecules that are the reverse complement of mRNA molecules transcribed from an endogenous target gene. Suppression of a target gene expression can also be achieved using a ribozyme. The production and use of ribozymes are disclosed in U.S. Pat. Nos. 4,987,071 and 5,543,508.

Cellulolytic Cells Having Multiple Target Genes Inhibited

Expression of at least two target genes may be reduced or inhibited in a cellulolytic cell as described herein. In some aspects, both clr-1 and clr-2 genes are inhibited. In cells where expression of both clr-1 and clr-2 are reduced or inhibited, the same technique (e.g. RNAi, mutagenesis, etc.) may be used to reduce the expression of both clr-1 and clr-2, or different techniques may be used to reduce the expression of each of clr-1 and clr-2.

In further aspects at least one additional gene involved in regulating protein secretion, such as cellulase secretion, may be reduced or inhibited in a cellulolytic cell as described herein. In some embodiments, the catabolite repressor gene cre-1 is reduced or inhibited in the cellulolytic cell. In cells where expression of cre-I in combination with clr-1 and/or clr-2 is reduced or inhibited, the same technique (e.g., RNAi, mutagenesis, etc.) may be used to reduce expression of cre-1, and clr-1 and/or clr-2. Alternatively, different techniques may be used to reduce the expression of each of cre-1, and clr-1 and/or clr-2.

Expression of Target Gene Inhibitors

Expression cassettes containing nucleic acids that encode target gene expression inhibitors, e.g., an antisense or siRNA, can be constructed using methods well known in the art. Constructs include regulatory elements, including promoters and other sequences for expression and selection of cells that express the construct. Typically, fungal and/or bacterial transformation vectors include one or more cloned coding sequences (genomic or cDNA) under the transcriptional control of 5' and 3' regulatory sequences and a dominant selectable marker. Such transformation vectors typically also contain a promoter (e.g., a regulatory region controlling inducible or constitutive, environmentally- or developmentally-regulated expression), a transcription initiation start site, an RNA processing signal (such as intron splice sites), a transcription termination site, and/or a polyadenylation signal.

In certain aspects, a cell which has a reduced level of expression clr-1, clr-2, or both clr-1 and clr-2 is fungus of the Ascomycota phylum. In some aspects, the cell which has a reduced level of expression clr-1, clr-2, or both clr-1 and clr-2 is of the genus *Metarhizium, Gibberella, Nectria, Magnaporthe, Neurospora, Sordaria, Chaetomium, Podospora, Verticillium, Glomerella, Grosmannia, Sclerotinia, Botryotinia, Aspergillus, Aspergillus, Penicillium, Leptosphaeria, Phaeosphaeria, Pyrenophora, Penicillium, Talaromyces, Trichoderma, Uncinocarpus, Coccidioidesi, Saccharomyces, Schizosaccharomyces, Sporotrichum (Myceliophthora), Thielevia, Acremonium, Yarrowia, Hansenula, Kluyveromyces, Pichia, Mycosphaerella, Neosartorya, Thermomyces (Humicola, Monotospora, Sepedonium),* or *Chrysosporium.*

In some aspects, the cell which has a reduced level of expression clr-1, clr-2, or both clr-1 and clr-2 is of the species *Neurospora crassa, Metarhizium anisopliae, Gibberella zeae, Nectria haematococca, Magnaporthe oryzae, Neurospora tetrasperma, Sordaria macrospora, Chaetomium globosum, Podospora anserina, Verticillium alboatrum, Glomerella graminicola, Grosmannia clavigera, Sclerotinia sclerotiorum, Botryotinia fuckeliana, Aspergillus oryzae, Aspergillus nidulans, Aspergillus niger, Aspergillus fumigatus, Penicillium chrysogenum, Leptosphaeria maculans, Phaeosphaeria nodorum, Pyrenophora tritici-repentis, Pyrenophora teres, Penicillium marneffei, Talaromyces stipitatus, Trichoderma reesei, Uncinocarpus reesii, Coccidioides immitus, Coccidioides posadasii, Saccharomyces cerevisiae, Schizosaccharomyces pombe, Sporotrichum thermophile (Myceliophthora thermophila), Thielavia terrestris-thermophilic, Acremonium cellulolyticus, Yarrowia lipolytica, Hansenula polymorpha, Kluyveromyces lactis, Pichia pastoris, Mycosphaerella graminicola, Neosartorya fischeri, Thermomyces lanuginosus (Humicola brevis, Humicola brevispora, Humicola grisea, Humicola lanuginosa, Monotospora lanuginosa, Sepedonium lanuginosum), Talaromyces thermophilus (Talaromyces dupontii, Penicillium dupontii),* or *Chrysosporium lucknowense.*

Applications

Methods of Increasing Cell Growth

Provided herein are methods for increasing the growth rate of a cell having one or more genes encoding cellulases. In one aspect, a method for increasing the growth rate of a cell having one or more genes encoding cellulases includes increasing the expression of clr-1, clr-2, or clr-1 and clr-2 polypeptides in the cell. Cells having increased expression of clr-1, clr-2, or clr-1 and clr-2 polypeptides in the cell may have an increased growth rate as compared with a corresponding cell not having increased expression of clr-1, clr-2, or clr-1 and clr-2 polypeptides in the cell. Alternatively, the growth rate of a cell having one or more genes encoding cellulases may be increased by mis-expressing recombinant nucleic acids encoding clr-1, clr-2, or clr-1 and clr-2 polypeptides in the cell. To increase the growth rate of a cell having one or more genes encoding cellulases, a cell containing recombinant nucleic acid(s) encoding clr-1, clr-2, or clr-1 and clr-2 polypeptides is incubated in media under conditions sufficient to support the expression of clr-1, clr-2, or clr-1 and clr-2. In some aspects, to increase the growth rate of a cell having one or more genes encoding cellulases, a cell containing recombinant nucleic acid(s) encoding clr-1, clr-2, or clr-1 and clr-2 polypeptides is incubated in media containing cellulose under conditions sufficient to support the expression of clr-1, clr-2, or clr-1 and clr-2. In other aspects, expression of at least one gene involved in regulating protein secretion, such as cellulase secretion, is reduced or inhibited in the cell. In some embodiments, expression of the catabolite repressor gene cre-1 is reduced or inhibited in the cell.

Methods for increasing the growth rate of a cell disclosed herein apply to all host cells disclosed herein.

Methods of Degrading a Cellulose-Containing Material

Provided herein are methods for degrading a cellulose-containing material. In one aspect, a method for degrading a cellulose-containing material includes the steps of: A) contacting a cellulose-containing material with a fungal host cell having at least one recombinant nucleic acid encoding clr-1, clr-2, or clr-1 and clr-2 transcription factor proteins in media under conditions necessary to support the expression of the at least one recombinant nucleic acid; and B) incubating the fungal host cell and cellulose-containing material under conditions t sufficient for the fungal host cell to degrade the cellulose-containing material. In certain embodiments, the fungal host cell is incubated under conditions sufficient for the fungal host cell to express said clr-2 transcription factor protein.

In another aspect, a method for degrading cellulose-containing material includes the steps of: A) incubating a fungal host cell having at least one recombinant nucleic acid encoding clr-1, clr-2, or clr-1 and clr-2 transcription factor proteins in media under conditions necessary to support the expression of the at least one recombinant nucleic acid; B) collecting one or more cellulases from the media and/or cell; and C) incubating the one or more cellulases from the media and/or cell with a cellulose-containing material under conditions sufficient for the one or more cellulases to degrade the t cellulose-containing material. In certain embodiments, the fungal host cell is incubated under conditions sufficient for the fungal host cell to express said clr-2 transcription factor protein.

In some embodiments, the fungal host cell produces a greater amount of one or more cellulases than a corresponding fungal host cell lacking the at least one recombinant nucleic acid.

In some embodiments, the method further includes reducing or inhibiting expression of at least one gene involved in regulating protein secretion, such as cellulase secretion. In certain preferred embodiments, the method further includes reducing or inhibiting expression of the catabolite repressor gene cre-1 is reduced or inhibited in the cell.

As used herein, a "cellulose-containing material" is any material that contains cellulose, including biomass, such as biomass containing plant material. Biomass suitable for use with the currently disclosed methods include any cellulose-containing material, and includes, without limitation, *Miscanthus*, switchgrass, cord grass, rye grass, reed canary grass, elephant grass, common reed, wheat straw, barley straw, canola straw, oat straw, corn stover, soybean stover, oat hulls, sorghum, rice hulls, rye hulls, wheat hulls, sugarcane bagasse, copra meal, copra pellets, palm kernel meal, corn fiber, Distillers Dried Grains with Solubles (DDGS), Blue Stem, corncobs, pine wood, birch wood, willow wood, aspen wood, poplar wood, energy cane, waste paper, sawdust, forestry wastes, municipal solid waste, waste paper, crop residues, other grasses, and other woods.

As an initial processing step in the degradation of biomass, biomass may be subjected to one or more pre-processing steps. Pre-processing steps are known to those of skill in the art, and include physical and chemical processes. Pre-processing steps include, without limitation, ammonia fiber expansion (AFEX), steam explosion, treatment with high temperature, treatment with high pressure, treatment with alkaline aqueous solutions, treatment with acidic solutions, treatment with organic solvents, treatment with ionic liquids (IL), treatment with electrolyzed water, and treatment with phosphoric acid.

In further embodiments, the fungal host cell may also have one or more recombinant nucleic acids that encode a polypeptide involved in a biochemical pathway for the production of at least one biofuel. Accordingly, the fungal host cell may also be incubated with degraded cellulose-containing material under conditions sufficient for the fungal host cell to convert the cellulose-containing material to at least one biofuel. Alternatively, the degraded cellulose-containing material may be cultured with a fermentative microorganism under conditions sufficient to produce at least one fermentation product from the degraded cellulose-containing material. Suitable biofuels and/or fermentation products include, without limitation, ethanol, n-propanol, n-butanol, iso-butanol, 3-methyl-1-butanol, 2-methyl-1-butanol, 3-methyl-1-pentanol, and octanol.

Methods for Reduction of the Viscosity of Pretreated Biomass Mixtures

Also provided herein are methods for reducing the viscosity of pretreated biomass mixtures, prior to the degradation of the pretreated biomass mixtures into monosaccharides and oligosaccharides.

Biomass that is used for as a feedstock, for example, in biofuel production generally contains high levels of lignin, which can block hydrolysis of the cellulosic component of the biomass. Typically, biomass is subjected to a pretreatment step to increase the accessibility of the cellulosic component to hydrolysis. However, pretreatment generally results in a biomass mixture that is highly viscous. The high viscosity of the pretreated biomass mixture can also interfere with effective hydrolysis of the pretreated biomass. Advantageously, the cells of the present disclosure having an increased expression of clr-1, clr-2, or clr-1 and clr-2 of the present disclosure, or cellulases produced from the cells, can be used to reduce the viscosity of pretreated biomass mixtures prior to further degradation of the biomass.

Accordingly, certain aspects of the present disclosure relate to methods of reducing the viscosity of a pretreated biomass mixture, by contacting a pretreated biomass mixture having an initial viscosity with any of the cells having an increased expression of clr-1, clr-2, or clr-1 and clr-2 of the present disclosure, or with cellulases produced from the cells, and incubating the contacted biomass mixture under conditions sufficient to reduce the initial viscosity of the pretreated biomass mixture.

In some aspects, the disclosed methods are carried out as part of a pretreatment process. The pretreatment process may include the additional step of adding any of the cells having an increased expression of clr-1, clr-2, or clr-1 and clr-2, of the present disclosure, or cellulases produced from the cells, to pretreated biomass mixtures after a step of pretreating the biomass, and incubating the pretreated biomass with the cells having an increased expression of clr-1, clr-2, or clr-1 and clr-2, or cellulases produced from the cells, under conditions sufficient to reduce the viscosity of the mixture. The cells having an increased expression of clr-1, clr-2, or clr-1 and clr-2, or the cellulases produced from the cells may be added to the pretreated biomass mixture while the temperature of the mixture is high, or after the temperature of the mixture has decreased. In some aspects, the methods are carried out in the same vessel or container where the pretreatment was performed. In other aspects, the methods are carried out in a separate vessel or container where the pretreatment was performed.

In some aspects, the methods are carried out in the presence of high salt, such as solutions containing saturating concentrations of salts, solutions containing sodium chloride (NaCl) at a concentration of at least at or about 0.5 M, 1 M, 1.5 M, 2 M, 2.5 M, 3 M, 3.5 M, or 4 M sodium chloride, or potassium chloride (KCl), at a concentration at or about 0.5 M, 1 M, 1.5 M, 2 M, 2.5 M 3.0 M or 3.2 M KCl and/or ionic liquids, such as 1,3-dimethylimidazolium dimethyl phosphate ([DMIM]DMP) or [EMIM]OAc, or in the presence of one or more detergents, such as ionic detergents (e.g., SDS, CHAPS), sulfydryl reagents, such as in saturating ammonium sulfate or ammonium sulfate between at or about 0 and 1 M. In other aspects, the methods are carried out over a broad temperature range, such as between at or about 20° C. and 50° C., 25° C. and 55° C., 30° C. and 60° C., or 60° C. and 110° C. In some aspects, the methods may be performed over a broad pH range, for example, at a pH of between about 4.5 and 8.75, at a pH of greater than 7 or at a pH of 8.5, or at a pH of at least 5.0, 5.5, 6.0, 6.5, 7.0, 7.5, 83.0, or 8.5.

Methods of Converting Cellulose-Containing Materials to Fermentation Product

Further provided herein are methods for converting cellulose-containing materials to a fermentation production. In one aspect, a method for converting a cellulose-containing material into a fermentation product includes the steps of: A) contacting a cellulose-containing material with a cell having at least one recombinant nucleic acid encoding clr-1, clr-2, or clr-1 and clr-2 transcription factor proteins under conditions sufficient to support expression of the nucleic acids; B) incubating the cellulose-containing material with the cell expressing the at least one recombinant nucleic acid encoding cdr-1, clr-2, or clr-1 and clr-2 transcription factor proteins under conditions sufficient for the fungal host cell to degrade the cellulose-containing material, in order to obtain sugars; and C) culturing the sugars with a fermentative microorganism under conditions sufficient to produce a fermentation product.

In another aspect, a method for converting a cellulose-containing material into a fermentation product includes the steps of: A) incubating a cell having recombinant nucleic acids encoding clr-1, clr-2, or clr-1 and clr-2 polypeptides in media under conditions necessary to support the expression of the recombinant nucleic acids; B) collecting cellulases from the media and/or cell; C) incubating cellulases from the media and/or cell with a cellulose-containing material under conditions that support cellulose degradation, in order to obtain sugars; and D) culturing the sugars with a fermentative microorganism under conditions sufficient to produce a fermentation product.

In some embodiments, the method further includes reducing or inhibiting expression of at least one gene involved in regulating protein secretion, such as cellulase secretion. In certain preferred embodiments, the method further includes reducing or inhibiting expression of the catabolite repressor gene cre-1 is reduced or inhibited in the cell.

Sugars that may be obtained from the degradation of cellulose-containing materials include, without limitation, glucose, cellobiose, xylose, arabinose, galactose, glucuronic acid, and mannose.

Fermentation products that may be produced from sugars obtained from the degradation of cellulose-containing materials include, without limitation, ethanol, n-propanol, n-butanol, iso-butanol, 3-methyl-1-butanol, 2-methyl-1-butanol, 3-methyl-1-pentanol, and octanol.

Fermentative organisms include, without limitation, *Saccharomyces* spp.

Methods of Consolidated Bioprocessing

Further provided herein are methods for converting cellulose-containing materials to a fermentation production, by consolidated bioprocessing. Consolidated bioprocessing combines enzyme generation, biomass hydrolysis, and biofuel production into a single stage. In one aspect, a method for converting a cellulose-containing material into a fermentation product by consolidated bioprocessing includes the steps of: A) contacting a cellulose-containing material with a cell having at least one recombinant nucleic acids encoding clr-1, clr-2, or clr-1 and clr-2 transcription factor proteins and one or more recombinant nucleic acids encoding a polypeptide involved in a biochemical pathway for the production of a biofuel under conditions sufficient to support expression of the nucleic acids; B) incubating the cellulose-containing material with the cell expressing the recombinant nucleic acids encoding clr-1, clr-2, or clr-1 and clr-2 transcription factor proteins and one or more recombinant nucleic acids encoding a polypeptide involved in a biochemical pathway for the production of a biofuel under conditions sufficient for the cell to degrade the cellulose-containing material and ferment the degraded cellulose-containing material, thereby producing a fermentation product.

In another aspect, a method for converting a cellulose-containing material into a fermentation product by consolidated bioprocessing includes the steps of: A) contacting a cellulose-containing material with a non-naturally occurring fungal cell, where the cell naturally contains genes encoding clr-1 and clr-2 transcription factor proteins, and where the cell contains modifications causing reduced expression of one or both of the clr-1 and clr-2 proteins, as compared to the expression of the clr-1 and clr-2 proteins in a corresponding fungal cell lacking said modifications, under conditions sufficient to support expression of the nucleic acids; B) incubating the cellulose-containing material with the non-naturally occurring fungal cell, where the cell naturally contains genes encoding clr-1 and clr-2 proteins, and where the cell contains modifications causing reduced expression of one or both of the clr-1 and clr-2 proteins, as compared to the expression of the clr-1 and clr-2 proteins in a corresponding fungal cell lacking said modifications, under conditions that support cellulose degradation and fermentation, in order to produce a fermentation product. In some aspects, in methods of consolidated bioprocessing involving a non-naturally occurring fungal cell, where the cell naturally contains genes encoding clr-1 and clr-2 proteins, and where the cell contains modifications causing reduced expression of one or both of the clr-1 and clr-2 proteins, as compared to the expression of the clr-1 and clr-2 proteins in a corresponding fungal cell lacking said modifications, the non-naturally occurring fungal cell further contains one or more recombinant nucleic acids encoding a cellulase.

In some embodiments, the method further includes reducing or inhibiting expression of at least one gene involved in regulating protein secretion, such as cellulase secretion. In certain preferred embodiments, the method further includes reducing or inhibiting expression of the catabolite repressor gene cre-1 is reduced or inhibited in the cell.

Fermentation products that may be produced from sugars obtained from the degradation of cellulose-containing materials include, without limitation, ethanol, n-propanol, n-butanol, iso-butanol, 3-methyl-1-butanol, 2-methyl-1-butanol, 3-methyl-1-pentanol, and octanol.

Methods of Increasing the Production of Cellulases

Provided herein are methods for increasing the production of cellulases from a cell having genes encoding one or more cellulases. In one aspect, a method for increasing the production of cellulases from a cell having genes encoding one or more cellulases includes increasing the expression of clr-1, clr-2, or clr-1 and clr-2 transcription factor proteins in the cell. Cells having increased expression of clr-1, clr-2, or clr-1 and clr-2 transcription factor proteins in the cell may have an increased production of cellulases as compared with a corresponding cell not having increased expression of clr-1, clr-2, or clr-1 and clr-2 transcription factor proteins in the cell. To increase the production of cellulases from a cell having one or more genes encoding cellulases, a cell containing recombinant nucleic acid(s) encoding clr-1, clr-2, or clr-1 and clr-2 transcription factor proteins is incubated in media under conditions sufficient to support the expression of clr-1, clr-2, or clr-1 and clr-2. In some aspects, to increase the production of cellulases from a cell having one or more genes encoding cellulases, a cell containing recombinant nucleic acid(s) encoding clr-1, clr-2, or clr-1 and clr-2 transcription factor proteins is incubated in media containing cellulose under conditions sufficient to support the expression of clr-1, clr-2, or clr-1 and clr-2.

In other aspects, a method of increasing the production of one or more cellulases from a fungal cell includes providing a fungal host cell having at least one recombinant nucleic acid encoding clr-1, clr-2, or clr-1 and clr-2 transcription factor proteins; and culturing the host cell under conditions sufficient to support the expression of the at least one recombinant nucleic acid, where the fungal host cell produces a greater amount of the one or more cellulases than a corresponding host cell lacking the at least one recombinant nucleic acid.

In some embodiments, the method further includes reducing or inhibiting expression of at least one gene involved in regulating protein secretion, such as cellulase secretion. In certain preferred embodiments, the method further includes reducing or inhibiting expression of the catabolite repressor gene cre-1 is reduced or inhibited in the cell.

In other embodiments, the fungal host cell is cultured in the absence of cellulose.

Methods for increasing the growth rate of a cell disclosed herein apply to all host cells disclosed herein.

Methods of Producing Cellulases

Also provided herein are methods for producing cellulases from a cell having genes encoding one or more cellulases. In one aspect, a method for producing cellulases from a cell having genes encoding one or more cellulases includes the steps of: A) incubating a cell having at least one recombinant nucleic acid encoding clr-1, clr-2, or clr-1 and clr-2 transcription factor proteins in media under conditions necessary to support the expression of the recombinant nucleic acids, and B) collecting cellulases from the media and/or cell. In some aspects, the media used for incubating a cell contains cellulose. In some aspects, the media used for incubating a cell does not contain cellulose.

In some embodiments, the method further includes reducing or inhibiting expression of at least one gene involved in regulating protein secretion, such as cellulase secretion. In certain preferred embodiments, the method further includes reducing or inhibiting expression of the catabolite repressor gene cre-1 is reduced or inhibited in the cell.

Cellulases that may be produced by the methods provided herein include any enzyme having cellulose-degrading activity, including endocellulases, exocellulases, beta-glucosidases, oxidative cellulases, and cellulose phosphorylases.

Cellulases can be collected from the media and/or cell by any method for protein purification and/or concentration, which are well known in the art. Proteins may be purified, without limitation, by ammonium sulfate fractionation and liquid chromatography, including ion-exchange, affinity, size-exclusion, and hydrophobic interaction chromatography. Proteins may be concentrated, without limitation, by ammonium sulfate fractionation, liquid chromatography, including ion-exchange, affinity, and hydrophobic interaction chromatography, and centrifugal ultrafiltration. Cells may be disrupted to release cellular content by any method known in the art, including mechanical, chemical, or enzymatic disruption.

Methods for producing cellulases from a cell having genes encoding one or more cellulases disclosed herein apply to all host cells disclosed herein.

Methods of Producing Hemicellulases

Also provided herein are methods for producing hemicellulases from a cell having genes encoding one or more hemicellulases. In one aspect, a method for producing hemicellulases from a cell having genes encoding one or more hemicellulases includes the steps of: A) incubating a cell having at least one recombinant nucleic acid encoding clr-1, clr-2, or clr-1 and clr-2 transcription factor proteins in media under conditions necessary to support the expression of the recombinant nucleic acids, and B) collecting hemicellulases from the media and/or cell. In some aspects, the media used for incubating a cell contains hemicellulose. In some aspects, the media used for incubating a cell does not contain hemicellulose.

In some embodiments, the method further includes reducing or inhibiting expression of at least one gene involved in regulating protein secretion, such as hemicellulase secretion. In certain preferred embodiments, the method further includes reducing or inhibiting expression of the catabolite repressor gene cre-1 is reduced or inhibited in the cell.

Hemicellulases that may be produced by the methods provided herein include any enzyme having hemicellulose-degrading activity, including, without limitation, exoxylanases, endoxylanases, □-arabinofuranosidases, □-glucuronidases, □-xylosidases, and acetyl xylan esterases.

Hemicellulases can be collected from the media and/or cell by any method for protein purification and/or concentration, which are well known in the art. Proteins may be purified, without limitation, by ammonium sulfate fractionation and liquid chromatography, including ion-exchange, affinity, size-exclusion, and hydrophobic interaction chromatography. Proteins may be concentrated, without limitation, by ammonium sulfate fractionation, liquid chromatography, including ion-exchange, affinity, and hydrophobic interaction chromatography, and centrifugal ultrafiltration. Cells may be disrupted to release cellular content by any method known in the art, including mechanical, chemical, or enzymatic disruption.

Methods for producing hemicellulases from a cell having genes encoding one or more hemicellulases disclosed herein apply to all host cells disclosed herein.

Methods of Analyzing Cellular Response to Cellulose and/or Genes Involved in Cellulose Metabolism In yet another aspect, provided herein are methods for analyzing a cellular response to cellulose. In one aspect, a method for analyzing a cellular response to cellulose involves the steps of: A) Obtaining a cell which naturally produces clr-1 and/or clr-2 that is modified to reduce expression of clr-1 and/or clr-2; B) contacting the cell which naturally produces clr-1 and/or clr-2 that is modified to reduce expression of clr-1 and/or clr-2 with a cellulose containing-material; and C) analyzing one or more components of the cell, such as a polypeptide or a nucleic acid, in response to the cellulose-containing material. In some aspects, a cell which naturally produces clr-1 and/or clr-2 that is modified to reduce expression of clr-1 and/or clr-2 further contains a recombinant nucleic acid, which encodes a polypeptide involved in cellulose metabolism. In some aspects, a polypeptide involved in cellulose metabolism is a cellulase. In some aspects, in a cell which naturally produces clr-1 and/or clr-2 that is modified to reduce expression of clr-1 and/or clr-2, and that contains a recombinant nucleic acid encoding a polypeptide involved in cellulose metabolism, the biological activity of the polypeptide involved in cellulose metabolism may be analyzed.

Cells may be modified to reduce the expression of clr-1 and/or clr-2 by any method disclosed herein for the reduction of expression of a gene

EXAMPLES

The following Examples are merely illustrative and are not meant to limit any aspects of the present disclosure in any way.

Example 1

Induction of Cellulose Degrading Enzymes in Wild Type *N. crassa*

To better understand the processes by which filamentous fungi sense and respond to cellulose in their environment, next generation RNA sequencing techniques were used to profile genome-wide mRNA abundance in *N. crassa*. For these experiments, cultures grown for 16 hrs in sucrose minimal medium (SMM; in linear growth phase), and then shifted the culture from SMM to cellulose as a sole carbon source (CMM; cellulose minimal medium) were used; RNA samples were taken at 30 min, 1 hr, 2 hr and 4 hr following shift from SMM to CMM and compared to a culture shifted to SMM at identical time points. Typical patterns of expression for genes known to be associated with cellulose degradation are depicted in FIG. 1A. This subset of genes increases in expression level approximately an order of magnitude within 30 min after transfer. Transcript abundance remains constant for approximately 1 hour before increasing by several more orders of magnitude between 2 and 4 hrs post transfer.

Figure 1B:
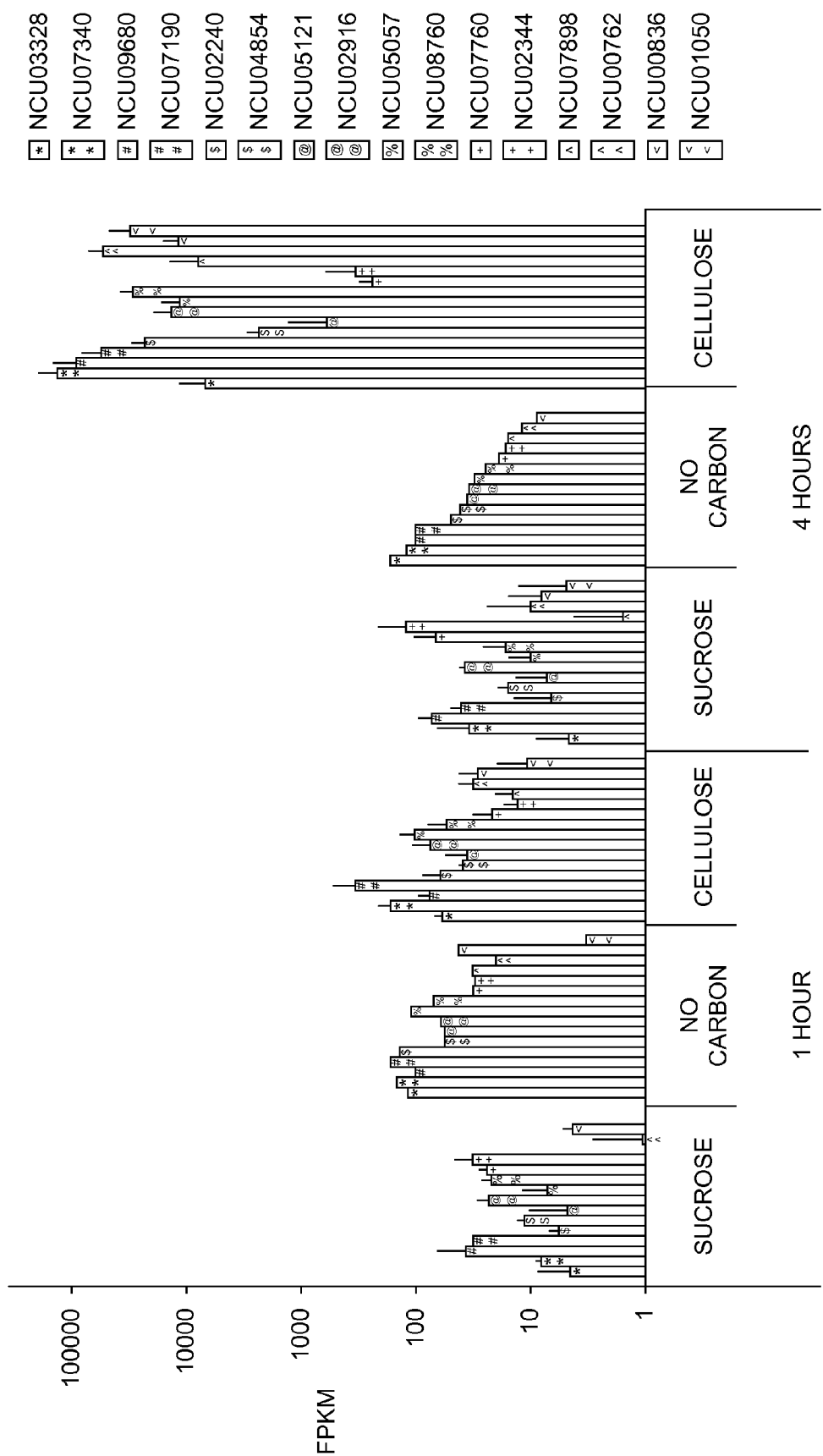
FIG. 1B depicts message abundance for 16 predicted *Neurospora crassa* cellulases after cultures are shifted to no carbon or a new carbon source.
Figure 1C:
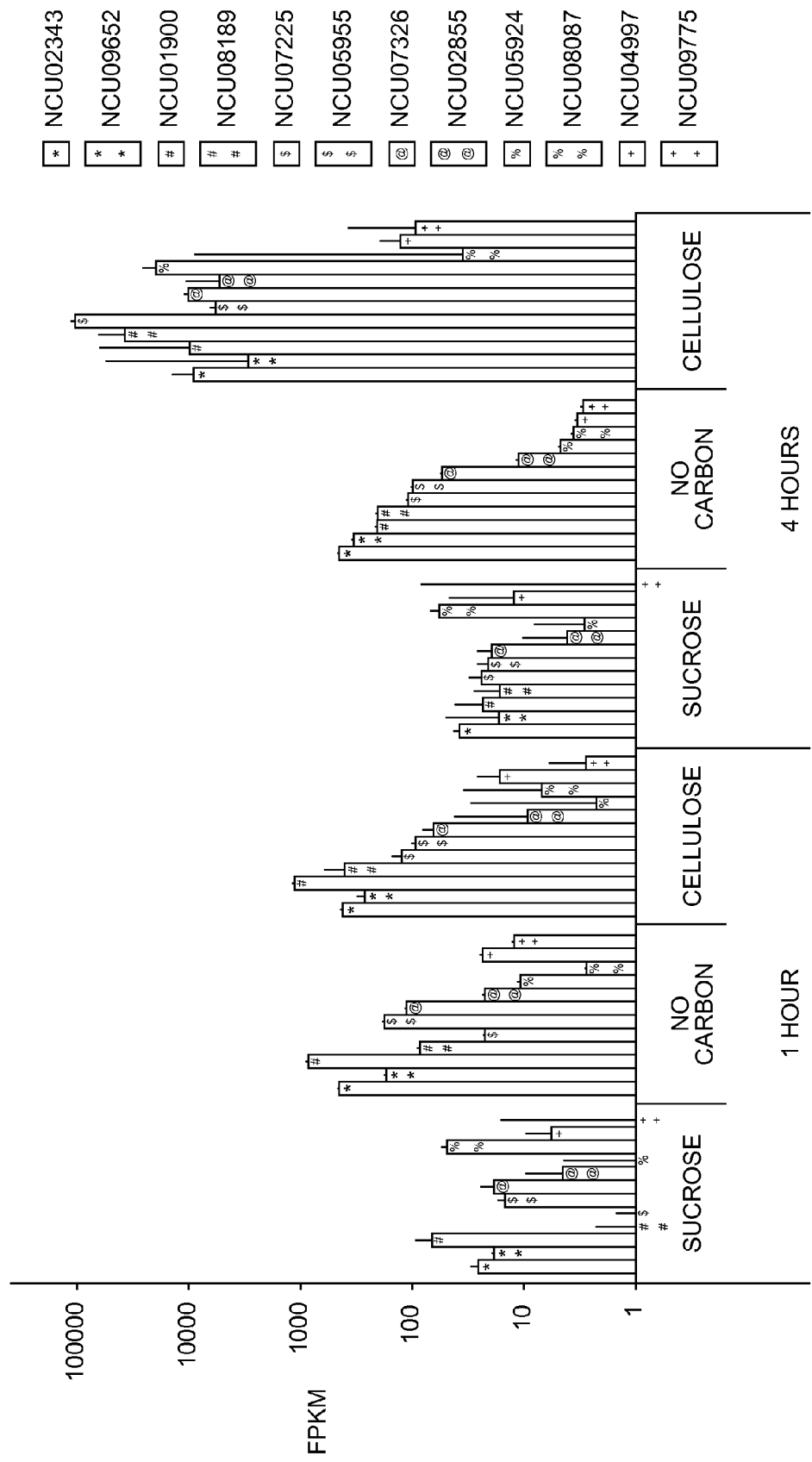
FIG. 1C depicts message abundance for 12 predicted *N. crassa* hemicelluses after cultures are shifted to a no carbon or a new carbon source. Abundances are given as fragments per kilobase of exon length per million reads fragments (FPKM) as calculated by Cufflinks.
Figure 2A:
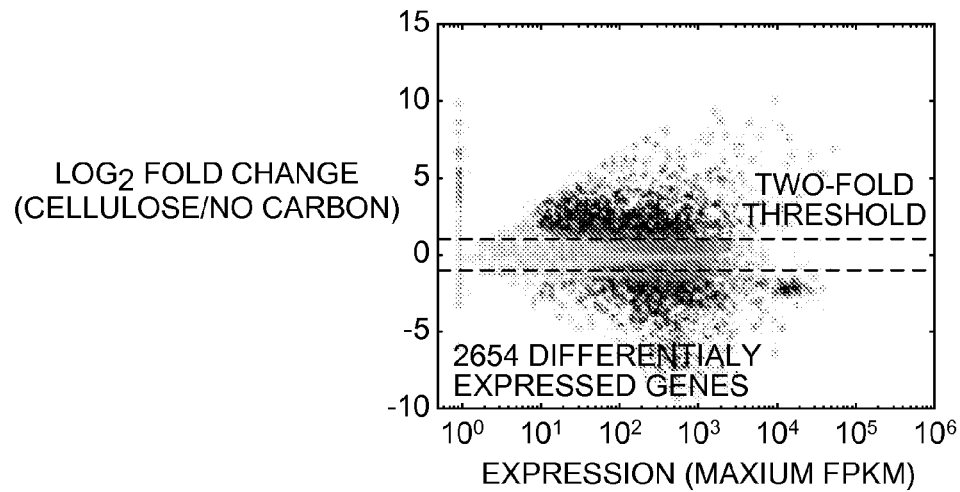
FIG. 2A depicts transcript abundance for the full *Neurospora crassa* (*N. crassa*) genome as compared between cellulose and sucrose cultures at 1 hour after transfer.
Figure 2B:
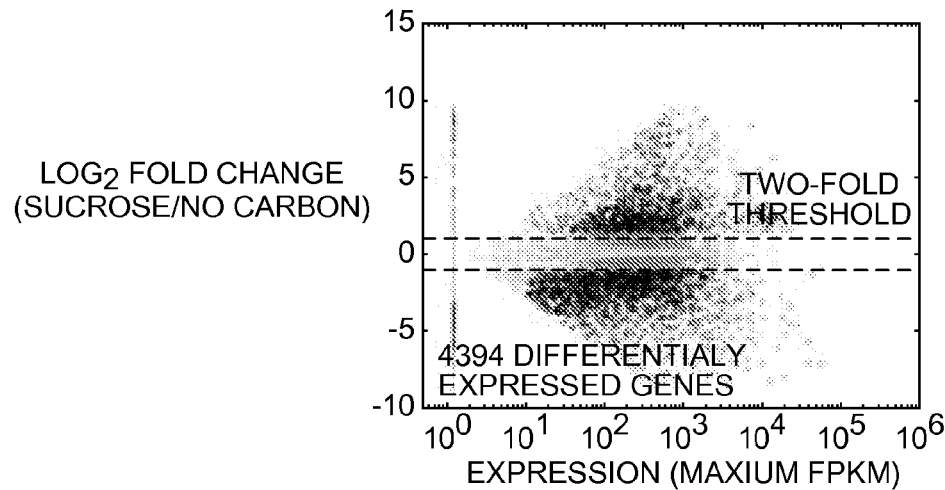
FIG. 2B depicts transcript abundance for the full *Neurospora crassa* (*N. crassa*) genome as compared between sucrose and no-carbon at 1 hour.
Figure 2C:
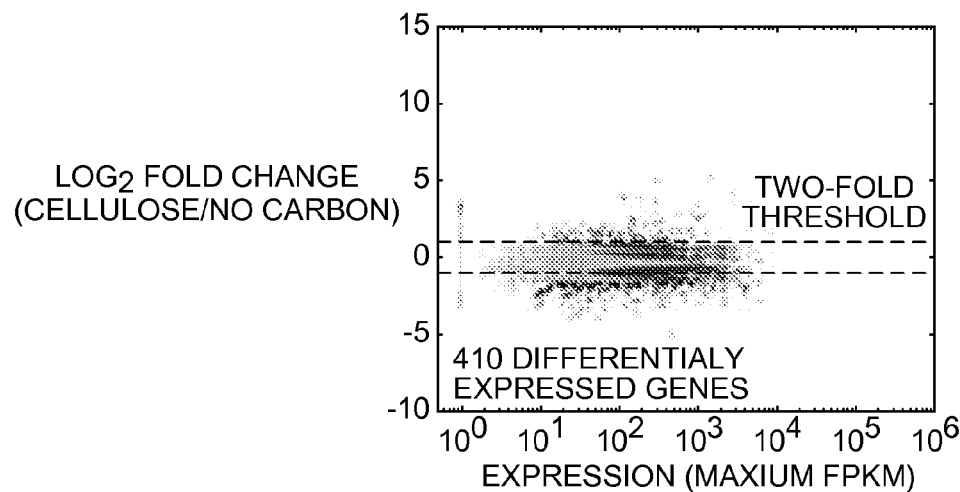
FIG. 2C depicts transcript abundance for the full *Neurospora crassa* (*N. crassa*) genome as compared between cellulose and no-carbon at 1 hour.
Figure 2D:
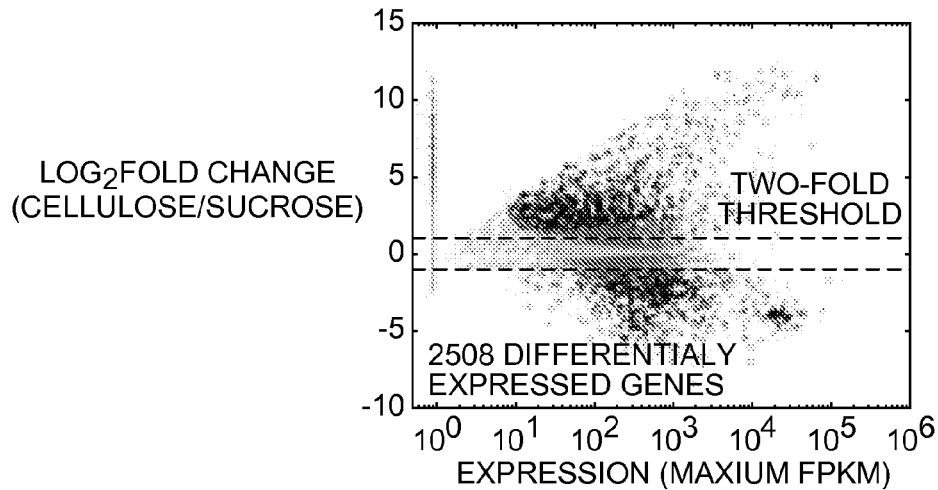
FIG. 2D depicts transcript abundance for the full *Neurospora crassa* (*N. crassa*) genome as compared between cellulose and sucrose at 4 hours.
Figure 2E:
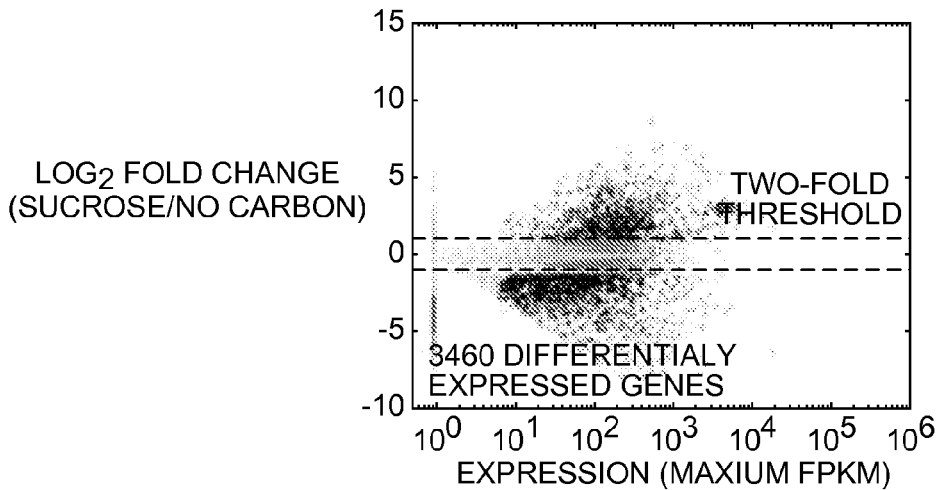
FIG. 2E depicts transcript abundance for the full *Neurospora crassa* (*N. crassa*) genome as compared between sucrose and no-carbon at 4 hours.
Figure 2F:
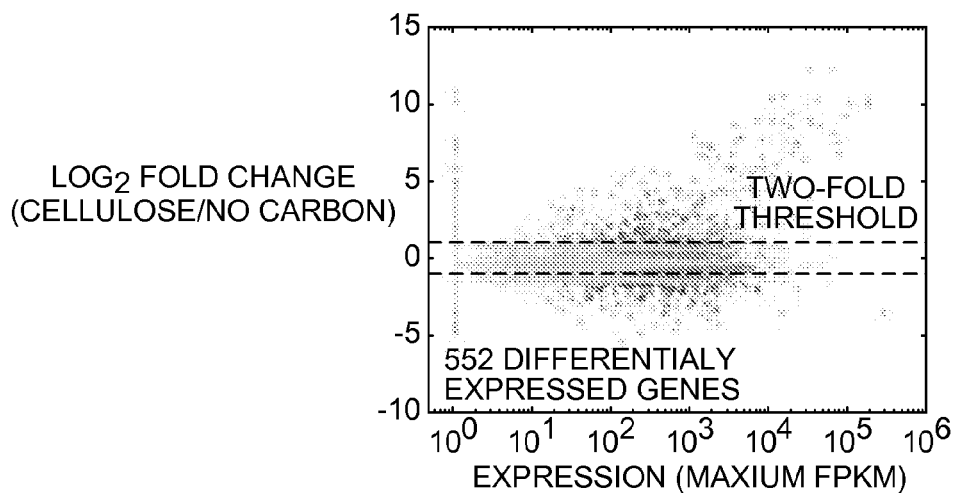
FIG. 2F depicts transcript abundance for the full *Neurospora crassa* (*N. crassa*) genome as compared between cellulose and no-carbon at 4 hours. $Log_2$ fold change is plotted against maximum abundance. For plotting purposes genes are given a minimum count of 1 FPKM in all conditions. Light-gray points are not statistically different by the model employed by Cuffdiff. Medium-gray points are statistically different, but not consistently different by a factor of 2 or more. Dark-gray/black points are statistically different and consistently different by 2-fold.

A very large number of genes change in expression profile following shift from SMM to CMM. Functional category analyses (Ruepp A et al., Nucleic Acids Res, 32: 5539-5545 (2004)) of this gene set revealed a large number are associated with the environmental stress response (Tian et al., Microbiology, 157: 747-759 (2011). We therefore determined the transcriptional profile when 16 hr SMM-grown cultures were transferred to media with containing no carbon (NC) source. We observed that transcripts for a large number of genes (including many cellulases and hemicellulases) undergo the same initial increase in abundance (30 min-1 hr), but not the secondary increase (2-4 hrs). In cultures shifted to SMM, transcripts remain at or near their initial abundances, commonly increasing up to 2-fold by 4 hours, but remaining well below abundance levels seen in cellulose or no-carbon cultures. These results suggest that the first stage of transcript accumulation is a result of the lifting of carbon-catabolite repression and a general starvation response. The second stage is likely the result of a specific induction of transcription in response to the presence of cellulose. Results for several predicted cellulases and hemicellulases depicting these trends are shown in FIGS. 1B and 1C, respectively. The first stage of transcript accumulation is likely a result of the lifting of carbon-catabolite repression and a general starvation response. The second stage is likely the result of a specific induction of transcription in response to the presence of cellulose.

To identify genes regulated at the level of transcription by the presence of cellulose, transcript abundances between libraries from the three carbon source conditions (SMM, CMM and NC) at 1 hr (starvation response) and 4 hrs (cellulose-specific response) after transfer were compared. Results from CMM and SMM cultures were performed in biological triplicate for these analyses. Differentially expressed genes were identified as those that (a) showed statistically significant changes in abundance as estimated by the Cuffdiff software package with a 5% false discovery rate and (b) showed at least a two-fold change in abundance consistently across all replicates of each condition.

Figure 3A:
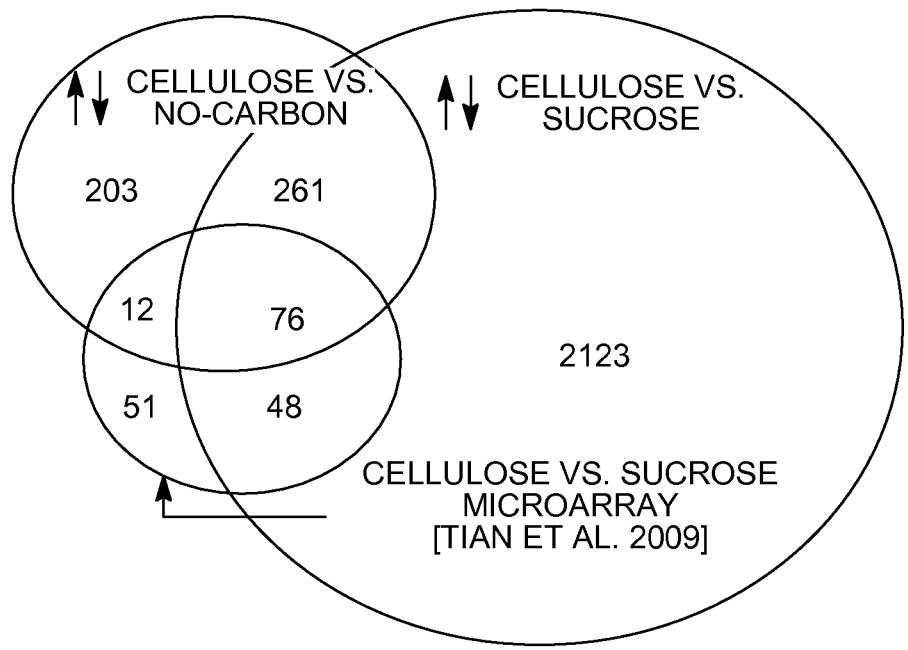
FIG. 3A depicts gene sets of differentially expressed genes from CMM vs. NC(RNAseq data, purple circle), and differentially expressed genes from CMM vs. SMM (RNAseq data, blue circle). A third gene set (Microarray data, red circle), includes differentially expressed genes from cultures grown on CMM for 30 hours vs SMM for 16 hrs, Tian et al., *Proc Nat Acad Sci USA*, 106: 22157-22162 (2009). Each of the 3 sets of differentially expressed genes includes both the up-regulated and down-regulated genes.
Figure 3B:
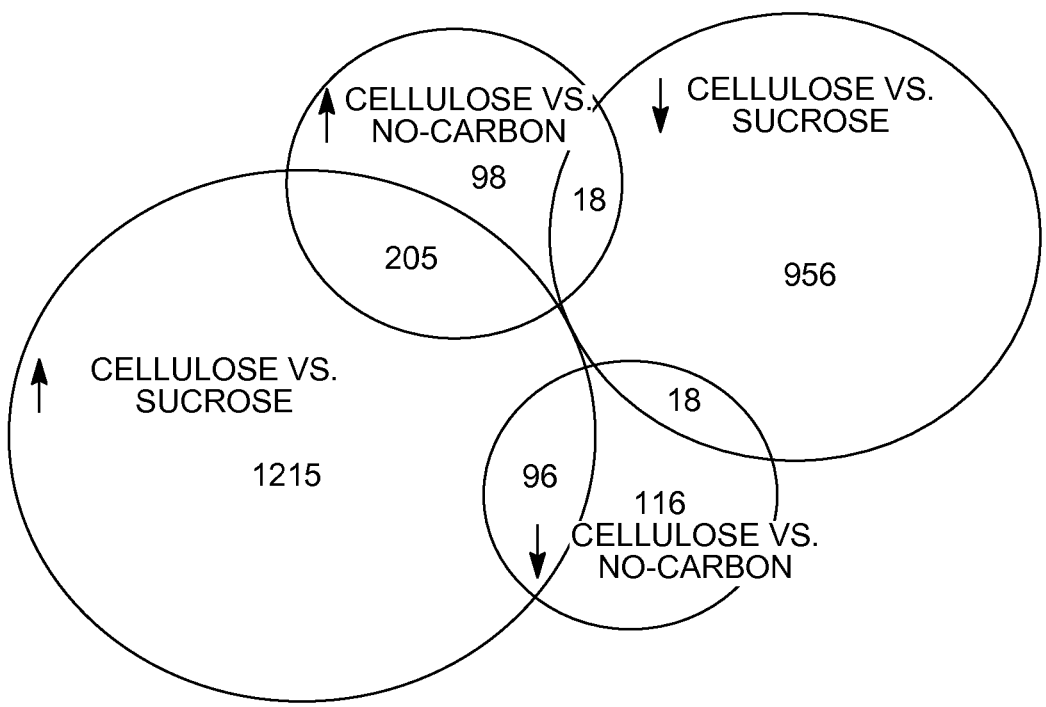
FIG. 3B depicts a comparison of the RNAseq derived differentially expressed gene lists from FIG. 3A and separates them into up-regulated and down-regulated gene sets (The microarray data was not included in this analysis). White arrows pointing upward indicate genes that are up-regulated and downward pointing arrows indicate down-regulated genes.

FIG. 2 illustrates the abundance changes observed among these conditions. As many as 45% of predicted transcripts in the *N. crassa* genome (nearly 4500 genes) have altered abundance in CMM or NC cultures as compared to SMM culture, representative of the broad physiological changes that occur rapidly on transfer to carbon-poor conditions (FIGS. 2A, 2B, 2D, and 2E). In contrast, at the one hour time point, a relatively small number of genes showed statistically differing transcript abundance in NC cultures compared to CMM cultures, with 410 genes showing differential expression, 276 of which are more highly expressed in the NC culture versus CMM (FIG. 2C). The majority (257) of these genes are more highly expressed in NC conditions than in SMM conditions and are therefore likely a general starvation response. Four hours after media transfer, a new collection of genes emerges in the far upper right of FIG. 2D (4 hr) versus FIG. 2A (1 hr) (CMM versus SMM) and especially in the upper portion of FIG. 2F (4 hr) versus FIG. 2C (1 hr) (CMM versus NC). These 552 differentially expressed genes depicted in FIG. 2F comprise the cellulose transcriptional response (genes that either increase in expression level or decrease in expression level). This group is more specific to cellulose induction rather than a general response to starvation. Of particular interest are the 321 genes showing elevated expression level on cellulose, with abundances up to 4,000 times that of the no-carbon cultures. This induced group of genes includes 16 of the 21 predicted cellulases and 12 of the 19 predicted hemicellulases from *N. crassa* genome. Also included are 30 less well-characterized enzymes with predicted carbohydrate hydrolase, esterase or lipase activity with probable secretion signal peptides and 4 enzymes with predicted activity on disaccharides and signal peptides, as well as 44 hypothetical proteins with predicted signal peptides (Tables 1A-1E; In Table 1A-1E, genes are indicated in the left side column; the listed genes are the same for each of Tables 1A-E. Tables 1A-1E contain different results relating to the same set of genes.). Cellulose also induces transcription of 21 genes with predicted roles in protein synthesis, modification and secretion as well as 8 predicted carbohydrate transporters, including recently characterized cellobiose transporters (Galazka et al., Science, 330: 84-86 (2010)). The resulting gene list includes approximately half of the genes identified in a similar study employing Bayesian analysis of microarray data (Tian et al., Proc Nat Acad Sci. USA, 106: 22157-22162, (2009)). Of those genes identified by Tian et al. that were not regulated by cellulose in our study, half were found to be differentially expressed under starvation and/or derepression conditions (FIG. 3).

Example 2

Essential Regulators for Cellulose Degradation

To identify transcription factors required for cellulose degradation, we screened the ~200 *N. crassa* transcription factor deletion collection for mutants with deficient growth on cellulose. Two mutants were identified with severe growth defects on cellulose but normal growth on sucrose. The corresponding genes, NCU07705 and NCU08042, were provisionally named cdr-1 and cdr-2, respectively for cellulose degradation regulator 1 and 2. However, it was later found that the "cdr" prefix was previously used for genes involved in cadmium resistance in N. crassa. Accordingly, the genes NCU07705 and NCU08042 were renamed as clr-1 and clr-2, respectively for cellulose degradation regulator 1 and 2. It should be noted that while some of the accompanying figures may refer to cdr-1 and cdr-2, the descriptions of these figures in Examples 2-4 below refer to cdr-1 as clr-1, and refer to cdr-2 as clr-2.

Figure 4A:
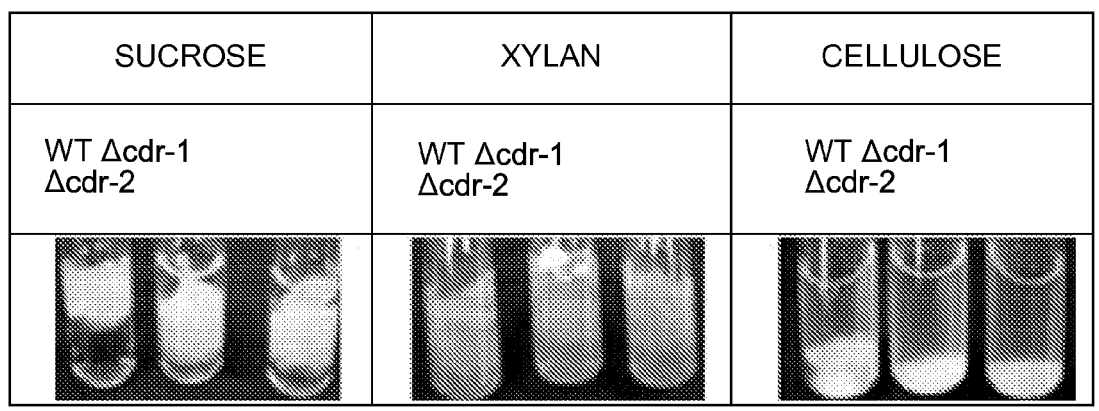
FIG. 4A depicts growth of wild type and deletion strains in 5 ml tubes with SMM, XMM or CMM.
Figure 4B:
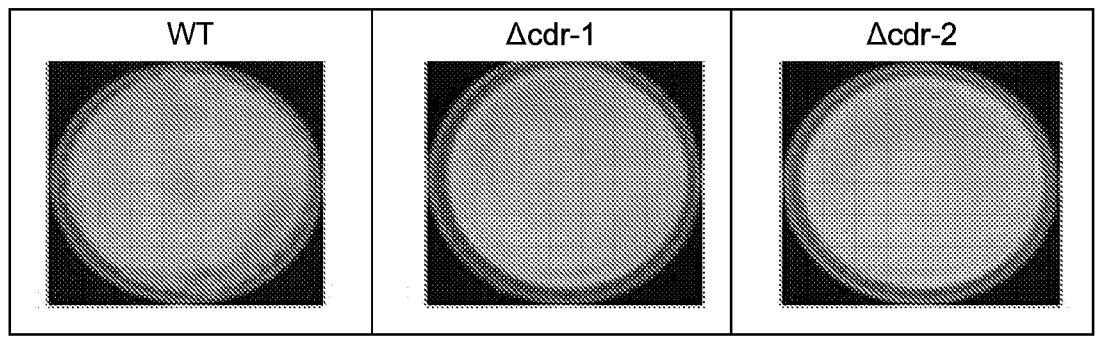
FIG. 4B depicts growth on a layer of saturated cellulose minimal medium.
Figure 4C:
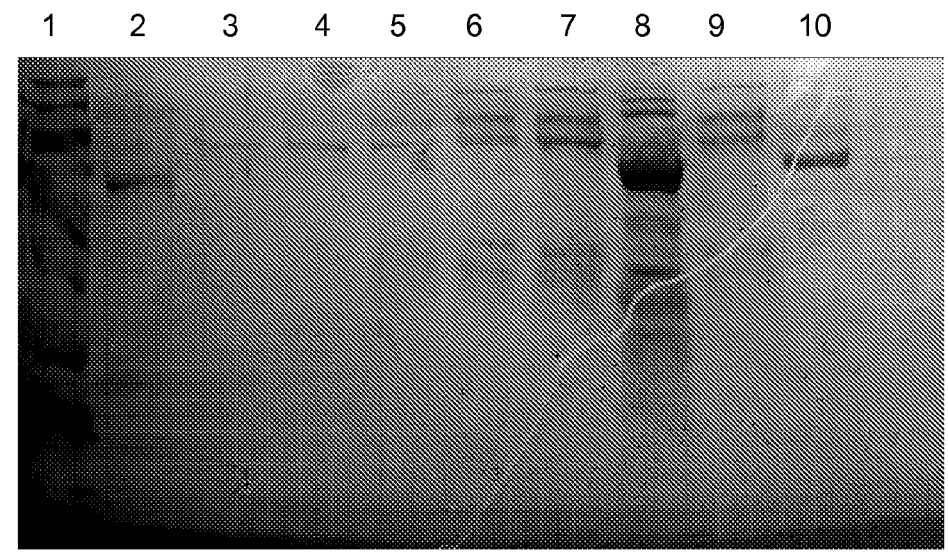
FIG. 4C depicts an SDS-PAGE gel of culture supernatants from SMM cultures (16 hr) transferred to CMM or XMM and incubated for 24 hrs. In the SDS-PAGE gel, lane 1 shows the protein ladder; lane 2 shows the results of the wild-type strain grown on sucrose; lane 3 shows the results of the Δclr-1 deletion strain grown on sucrose; lane 4 shows the results of the Δclr-2 deletion strain grown on sucrose; lane 5 shows the results of the wild-type strain grown on xylan; lane 6 shows the results of the Δclr-1 deletion strain grown on xylan; lane 7 shows the results of the Δclr-2 deletion strain grown on xylan; lane 8 shows the results of the wild-type strain grown on Avicel®; lane 9 shows the results of the Δclr-1 deletion strain grown on Avicel®; and lane 10 shows the results of the Δclr-2 deletion strain grown on Avicel®.
Figure 4D:
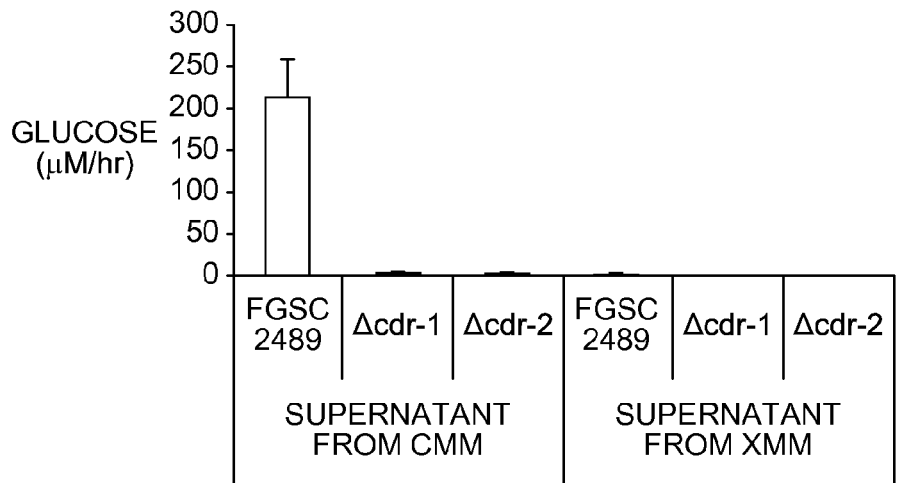
FIG. 4D depicts total cellulase activity as measured by glucose release from cellulose (Tian et al., *Proc Nat Acad Sci USA*, 106: 22157-22162 (2009)) in supernatants from 16 hr SMM cultures transferred to either CMM or XMM for 24 hrs.
Figure 4E:
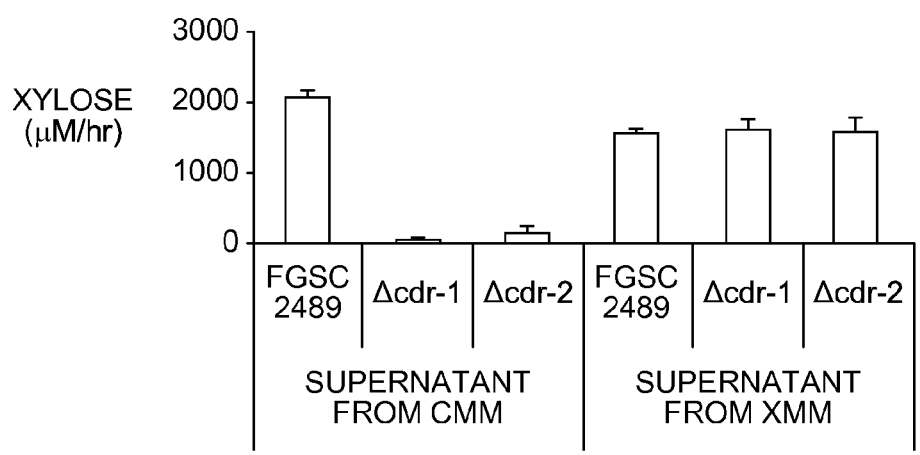
FIG. 4E depicts total xylanase activity as measured by reducing sugars released from xylan from CMM or XMM cultures from FIG. 4D.
Figure 4F:
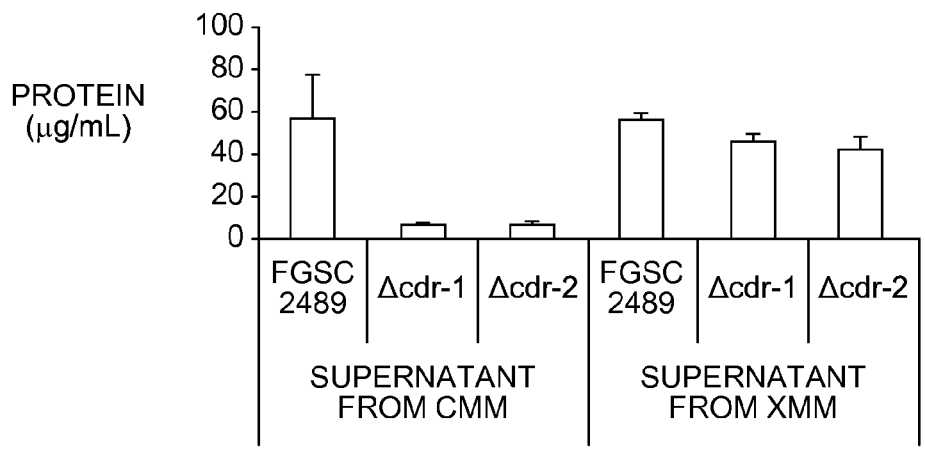
FIG. 4F depicts total protein as measured by the Bradford assay in CMM or XMM cultures from FIG. 4D.
Figure 5A:
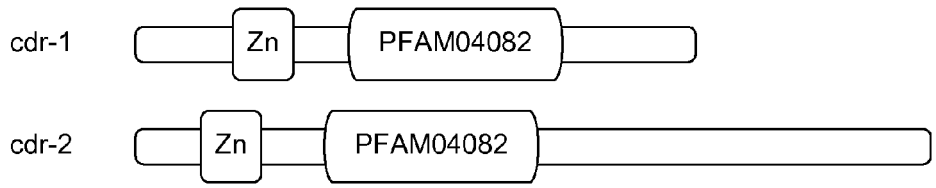
FIG. 5A depicts the domain architecture of cdr-1 (clr-1) and cdr-2 (clr-2) showing PFAM domains that are conserved among Zn(2) Cys(6) binuclear cluster transcription factors.

Deletion mutants for clr-1 and clr-2 exhibit little to no growth on cellulose, PASC or CMC in either liquid or solid culture, but exhibit wild type growth on minimal medium containing xylan (XMM), a hemicellulose, as a sole carbon source (FIGS. 4A and 4B). Furthermore, when dr mutants are grown on SMM and subsequently transferred to CMM, they are deficient for cellulase and hemicellulase activity and secretion, as well as total protein secretion. However, when transferred to xylan and allowed to grow for 24 hr, they exhibit normal hemicellulase enzyme activity and protein secretion (FIGS. 4C-4F). These phenotypes were taken as evidence that clr-1 and clr-2 are essential transcription factors for the specific detection and metabolic response to the presence of cellulose.

clr-1 and clr-2 encode proteins that belong to the fungal specific zinc binuclear cluster superfamily. This large and diverse family of transcriptional regulators includes many previously described regulators of alternative carbon metabolism, including gal-4, ace-I, and xlnR (xyr-1) (Stricker et al., App. Micro Biotech., 78: 211-220 (2008)). Members of this family typically maintain two conserved domains, a zinc (2) cysteine (6) binuclear cluster coordinating DNA binding, and a conserved central domain roughly corresponding to what is known as the middle homology region (Campbell et al., Biochem. J., 414: 177-187 (2008)). As shown in FIG. 5A, clr-1 and clr-2 also contain the conserved zinc (2) cysteine (6) binuclear domain, as well as a conserved central PFAM04082 domain.

An examination of the expression patterns of clr-1 and clr-2 reveals potential differences in their regulation and mode of action. Both genes are essentially off under SMM conditions, however upon exposure to cellulose, clr-1 transcript levels increase within the first 30 minutes and then slowly increase throughout the 4 hr time point. Meanwhile, clr-2 expression levels remain low at 30 minutes, increases slightly by 1 hour, but doesn't dramatically increase until the 4 hr time point (FIG. 5C). Thus, clr-2 expression closely mimics the expression pattern of cellulolytic genes, and thus may undergo a similar de-repression stage.

clr-1 and clr-2 expression is also specific to cellulose. Exposure and growth in SMM, XMM and NC have little effect on clr-1 or clr-2 transcript levels when compared to cellulose (FIG. 5D). However, although abundance of clr-1 transcript under CMM conditions is relatively unaffected in the clr-2 deletion strain, the induction of clr-2 expression upon cellulose exposure is abolished in a clr-1 mutant. Thus, accumulation of clr-2 transcript requires both the expression of clr-1 and the presence of the cellulose signal.

Figure 5B:
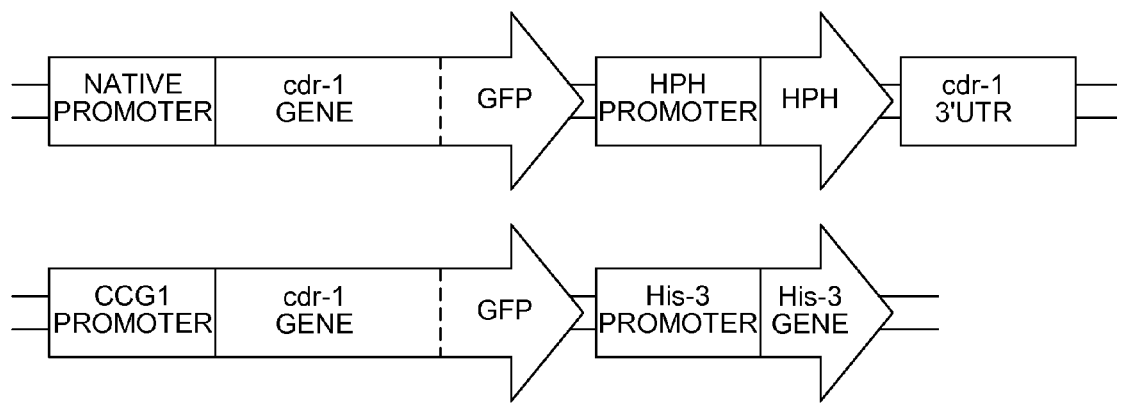
FIG. 5B depicts the construct design for natively tagged cdr-1-GFP tagging and a mis-expression cdr-1 construct (under regulation of the ccg-1 promoter).
Figure 5C:
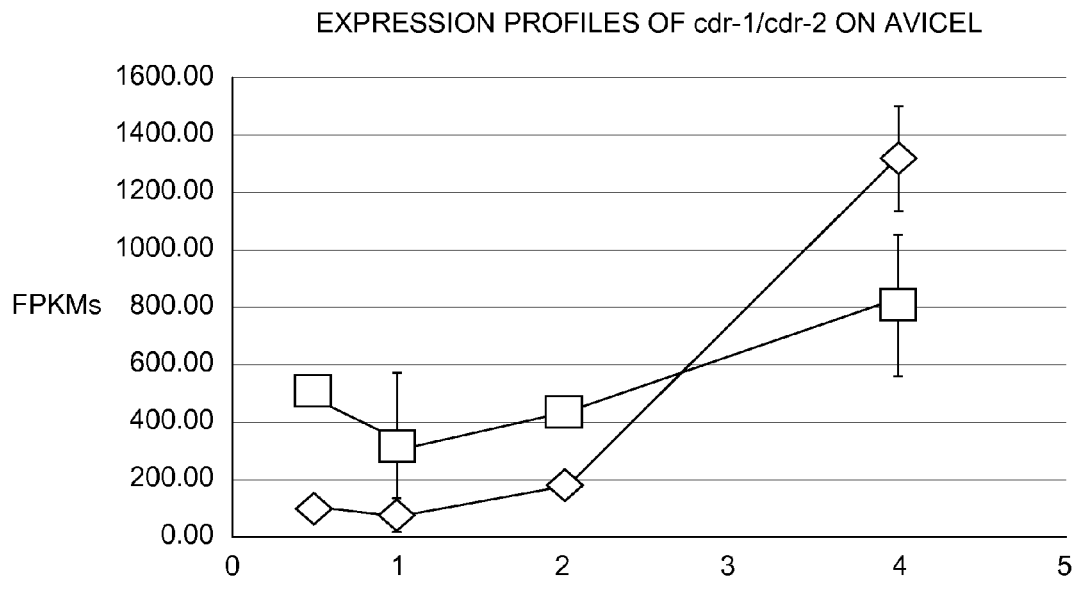
FIG. 5C depicts expression profiles of cdr-1 and cdr-2 following shift of a SMM-grown culture to CMM.
Figure 5D:
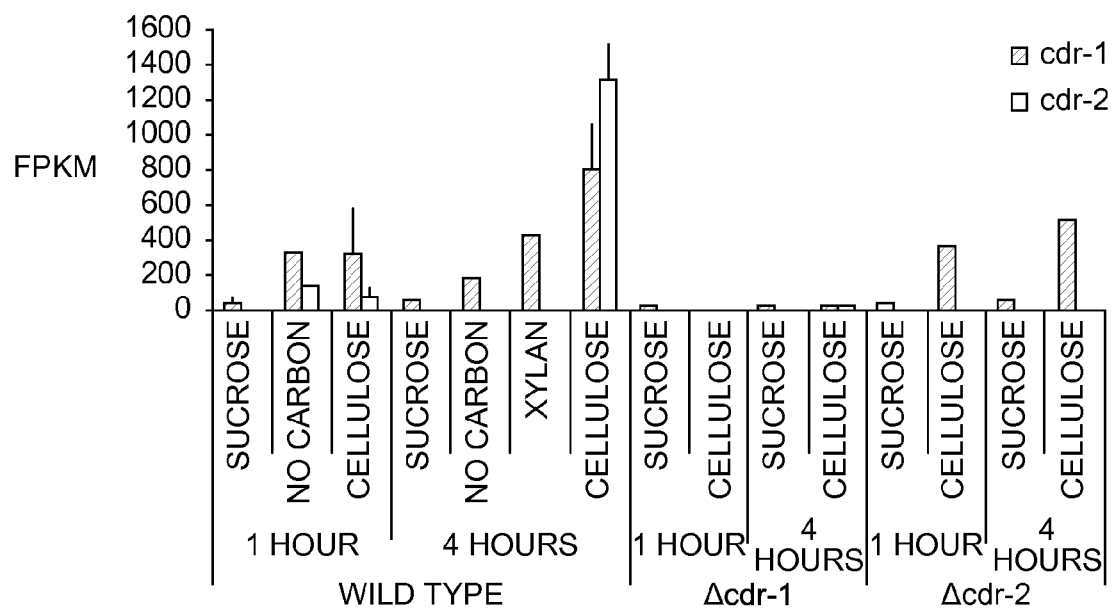
FIG. 5D depicts FPKMs derived from cdr-1 and cdr-2 in a wild type *N. crassa* versus a cdr-1 or cdr-2 mutant. Note that expression of cdr-2 is dependent upon the presence of functional cdr-1, while expression of cdr-1 is similar to wild type in a cdr-2 mutant.
Figure 5E:
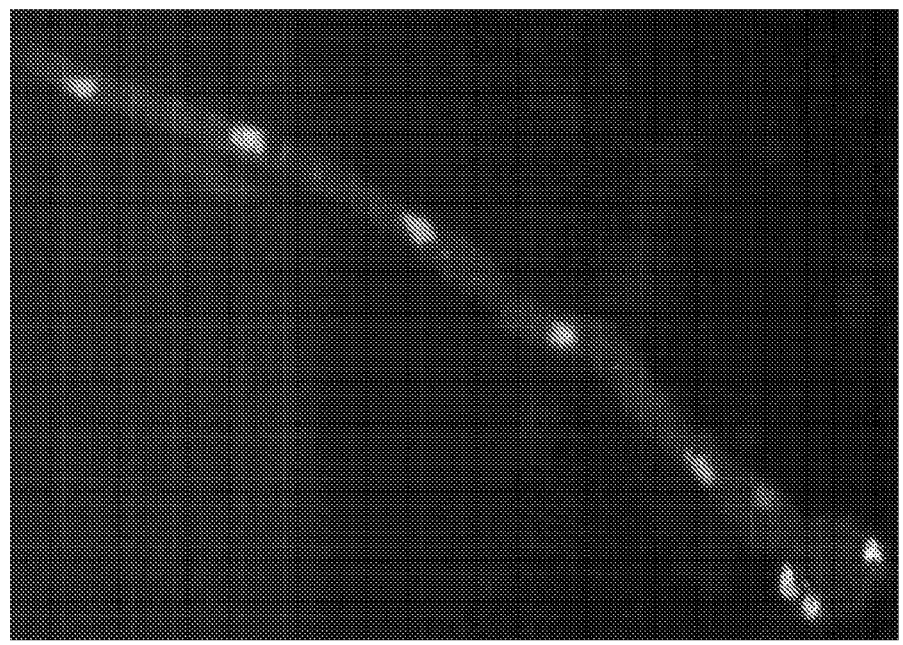
FIG. 5E depicts the nuclear localization of natively GFP tagged CDR-1 (CLR-1).
Figure 5F:
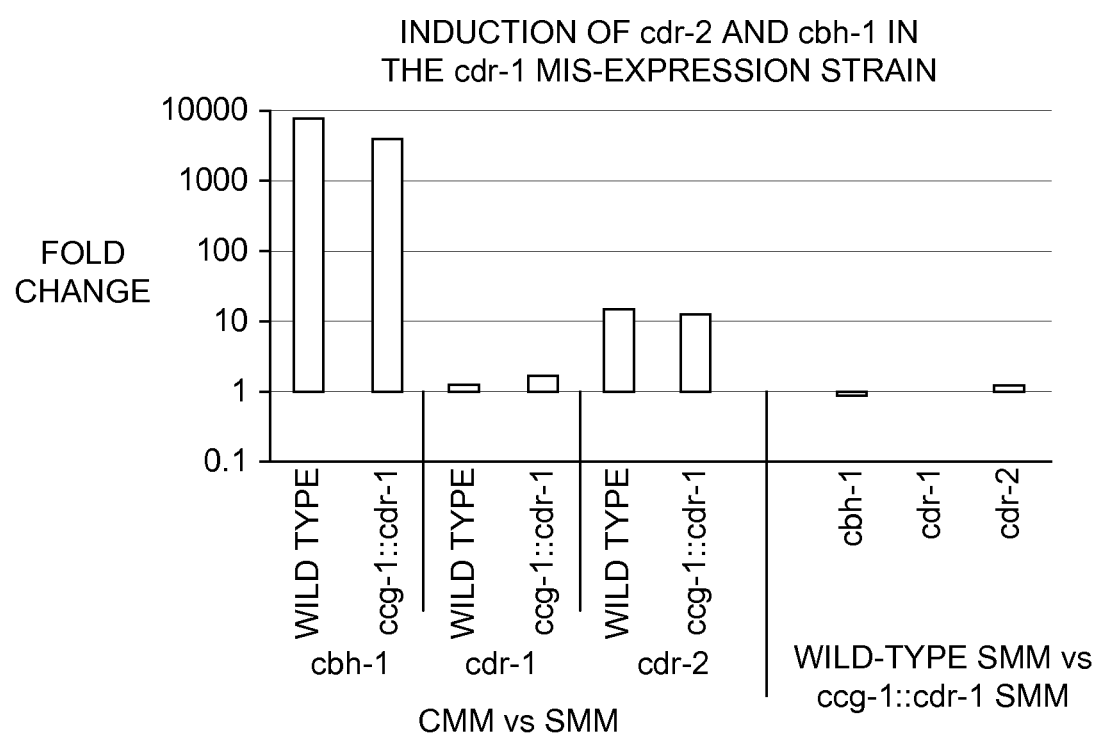
FIG. 5F depicts the relative expression of cbh-1 (NCU07340) and cdr-2 in the ccg1::cdr-1 strain on CMM versus SMM indicates that mis-expression of cdr-1 has no effect on expression levels of either cbh-1 or cdr-2.

To determine whether mis-expression of clr-1 could induce clr-2 expression in the absence of cellulose, clr-1 was tagged with GFP and placed under the constitutively expressed promoter ccg-1 (FIG. 5B). The ccg-1 clr-1-gfp construct was able to complement for the clr-1 knockout and showed localization of CLR-1 to the nucleus (FIG. 5E). When grown on CMM, RT-qPCR analysis shows wild type induction of clr-2 and the major cellulase NCU07340 (cbh-1) in the ccg-1 clr-1-gfp strain (FIG. 5F). However, when the ccg-1 clr-1-gfp strain was grown in SMM, expression levels of cbh-1 and clr-2 remain the same as wild-type grown on in SMM (FIG. 5F). Thus, inappropriate expression of clr-1 in SMM is not sufficient to induce expression of clr-1 or the cellulolytic regulon. This result suggests that clr-1 is post-transcriptionally modified in order to induce clr-2 and cellulase expression.

Example 3

Phylogenetic Analysis

Figure 6:
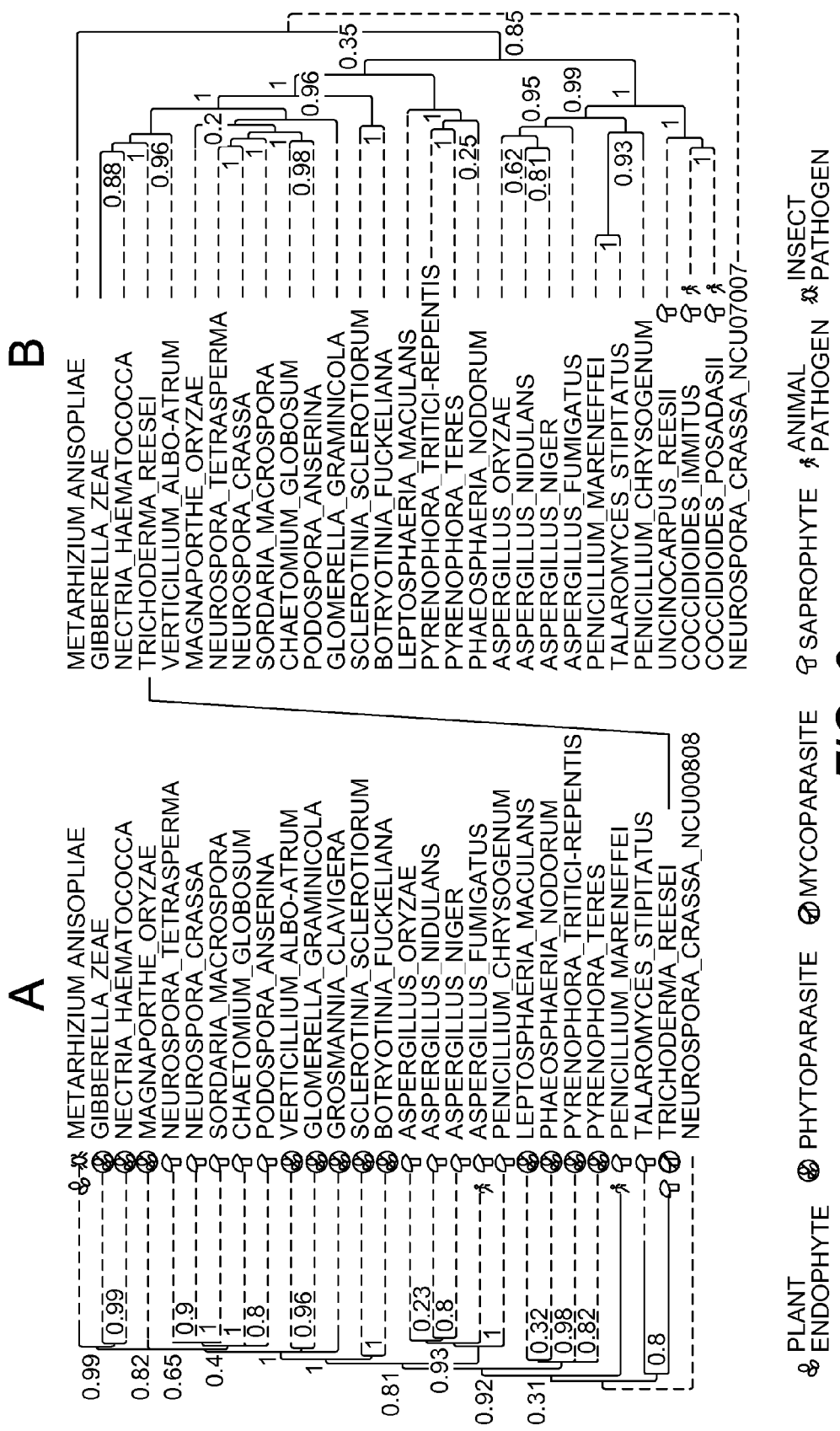
FIG. 6 depicts maximum likelihood phylogenetic trees of cdr-1 (clr-1) and cdr-2 (clr-2).
Figure 9A:
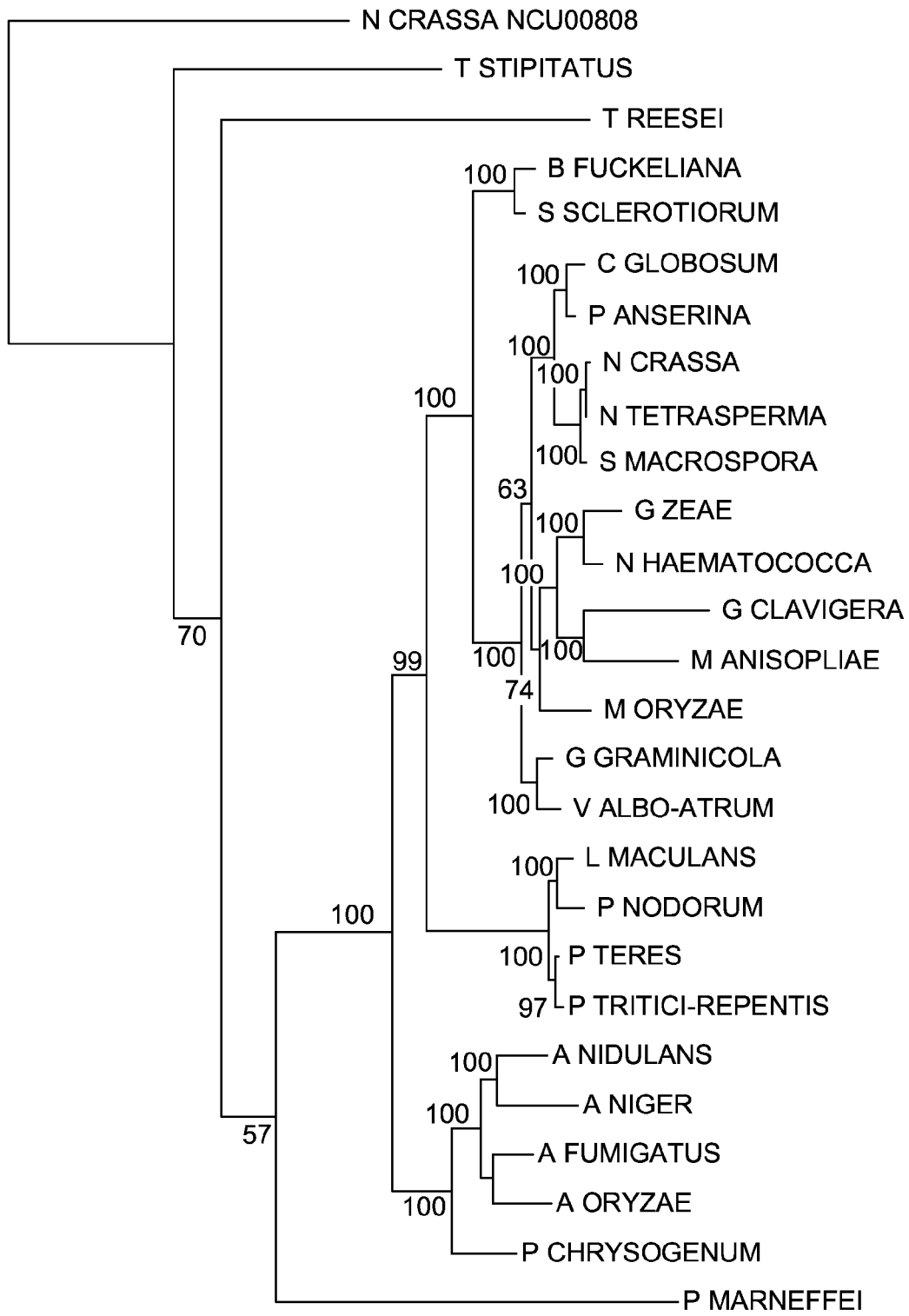
FIG. 9A depicts a cdr-1 (clr-1) tree.
Figure 9B:
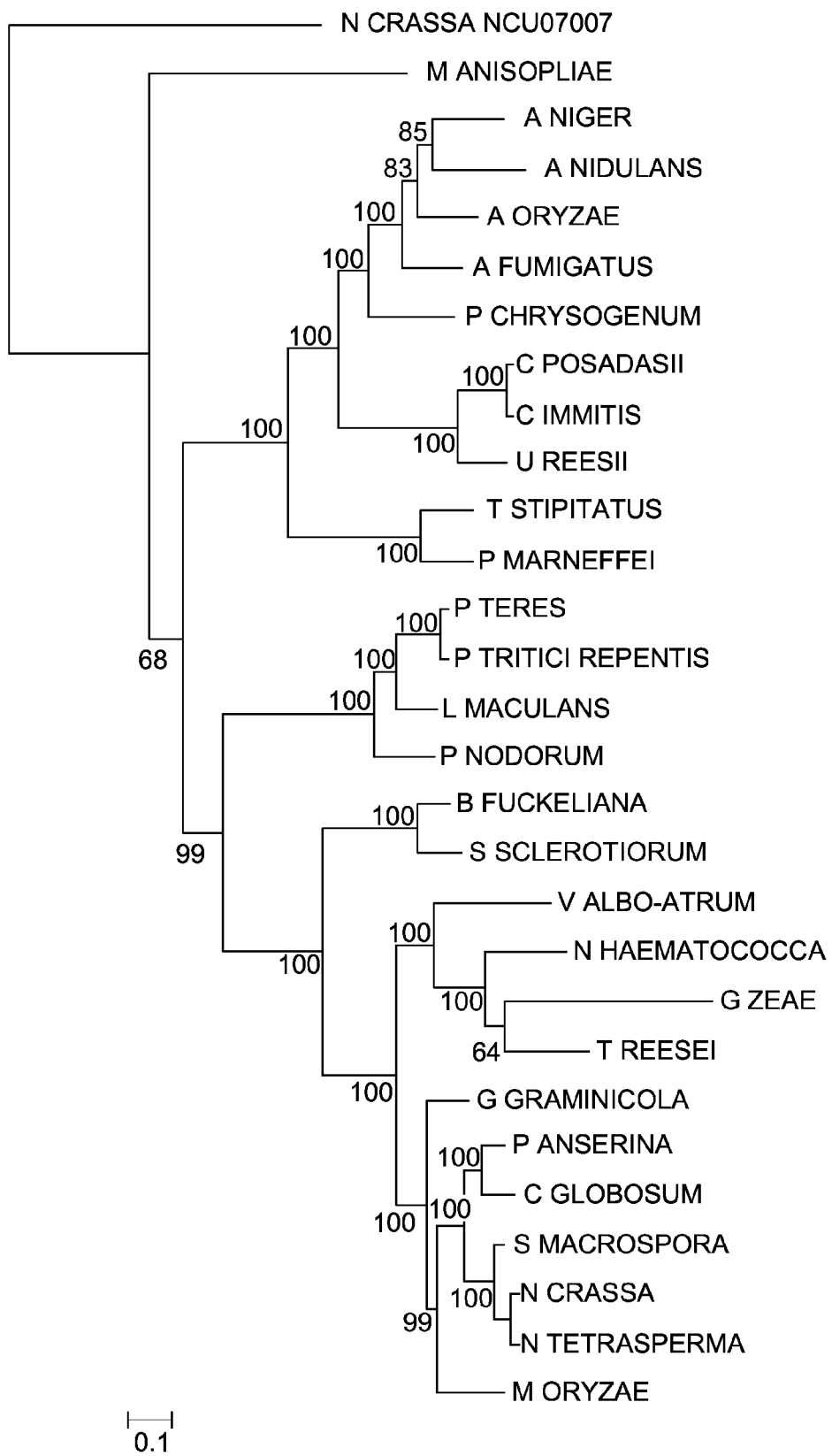
FIG. 9B depicts a cdr-2 (clr-2) tree.

A phylogenetic analysis of clr-1 and clr-2 was conducted to gain insight on the evolutionary history of the two genes. Maximum likelihood phylogenetic trees of clr-1 and clr-2 homologs largely recapitulated previous fungal trees (FIG. 6). Trees created using Bayesian inference also shows congruent trees (FIG. 9). Similarities between the two trees lend support to the idea that CLR-1 and CLR-2 may be co-evolving and the hypothesis that they may act together as a heterocomplex.

Example 4

CLR-1 and CLR-2 Regulons

Figure 7A:
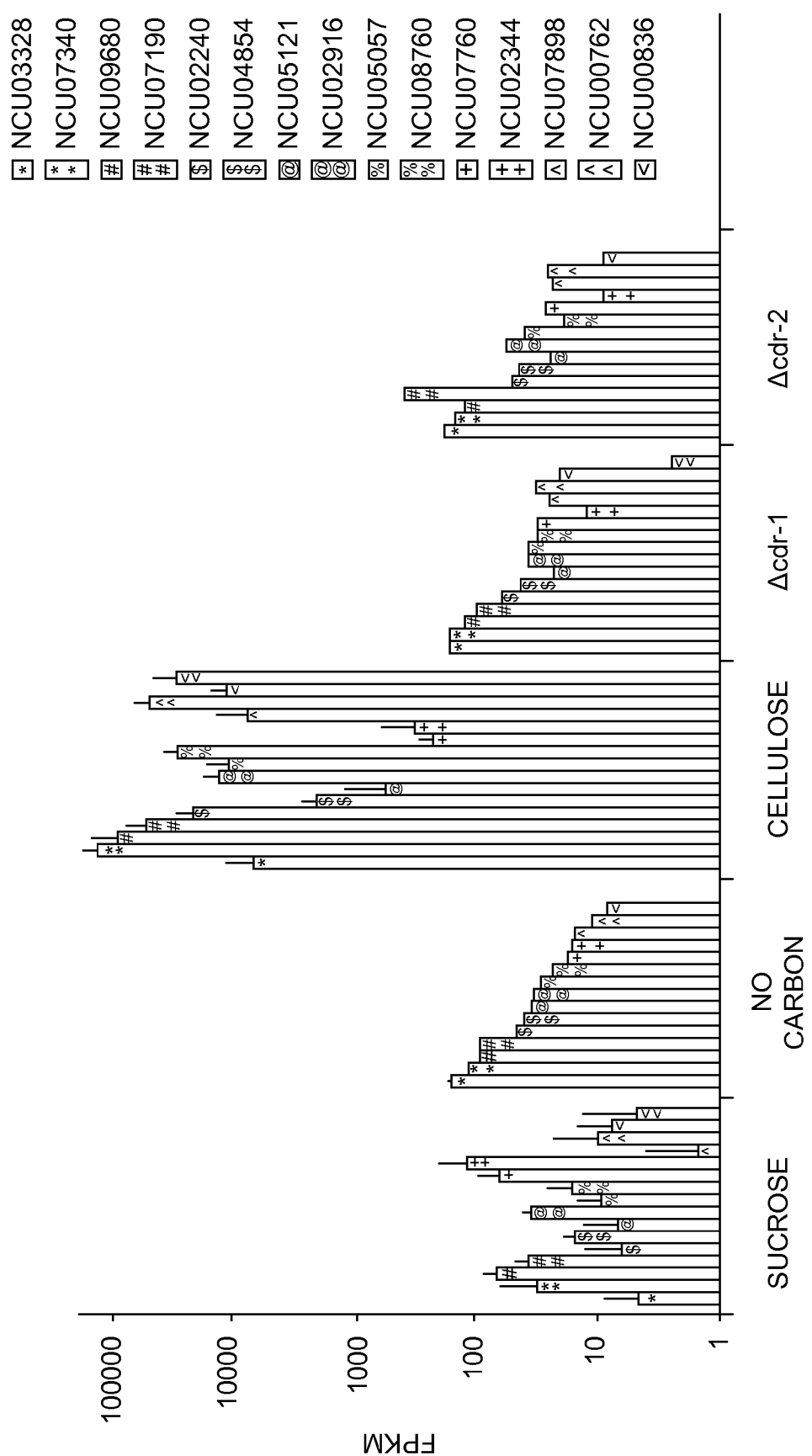
FIG. 7A depicts transcript abundance of predicted cellulase genes in wild type and cdr mutant strains at 4 hrs after transfer to CMM.
Figure 7B:
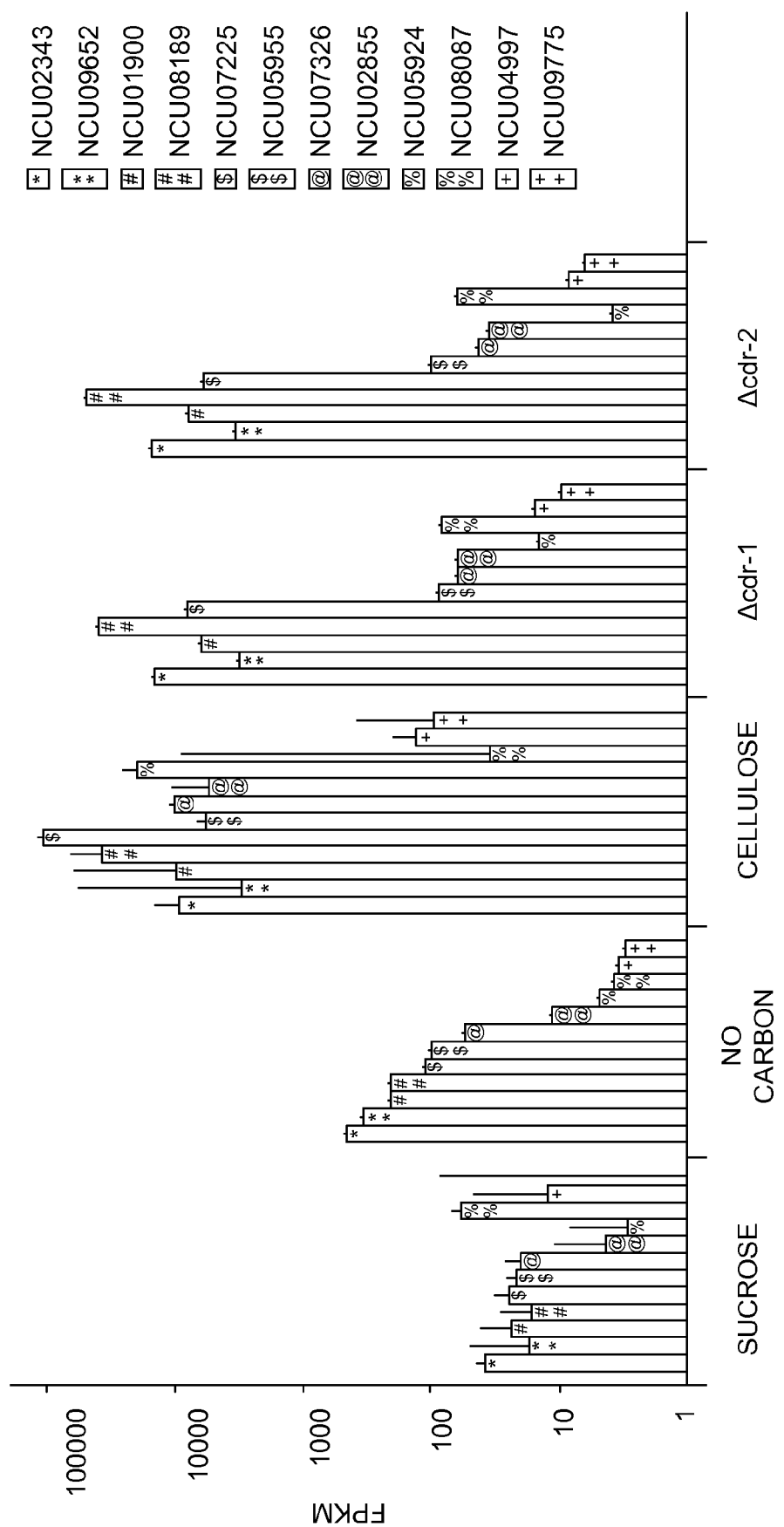
FIG. 7B depicts expression profiles of predicted hemicellulase genes in wild type and cdr mutant strains at 4 hrs after transfer to CMM.

Strains containing deletions of clr-1 or clr-2 have similar global expression profiles to a wild type strain when transferred from SMM to NC. Importantly, predicted cellulase genes have FPKMs that are similar both in magnitude and relation to each other in wild type NC culture as compared to Δclr-1 or Δclr-2 CMM cultures (FIG. 7A). Thus wild type NC cultures and the Δclr-1 or Δclr-2 CMM culture appear to undergo an identical starvation response. When compared to wild type on CMM, it is clear that both Δclr-1 and Δclr-2 mutants failed to induce cellulase gene transcripts in response to exposure to cellulose and are therefore starving (FIG. 7A). Under CMM conditions, hemicellulase gene profiles were more mixed in the Δclr-1 or Δclr-2 mutants, with transcripts from some predicted hemicellulase genes showing wild type abundance in the Δclr-1 or Δclr-2 mutants, while others were dependent upon functional clr-1 and clr-2 for induction (FIG. 7B).

Figure 7C:
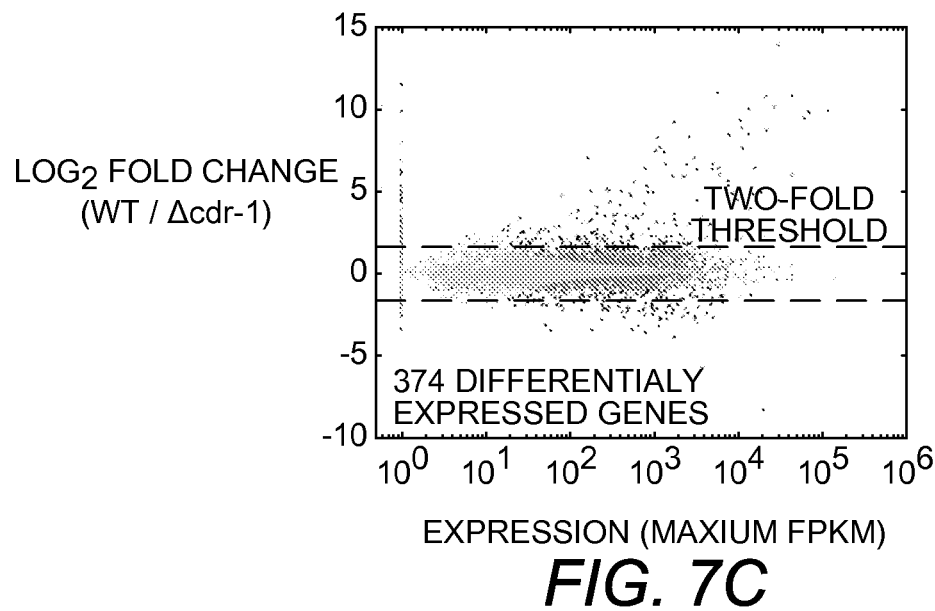
FIG. 7C depicts global expression in Δcdr-1 (Δclr-1) as compared to wild type after transfer to CMM for 4 hrs.
Figure 7D:
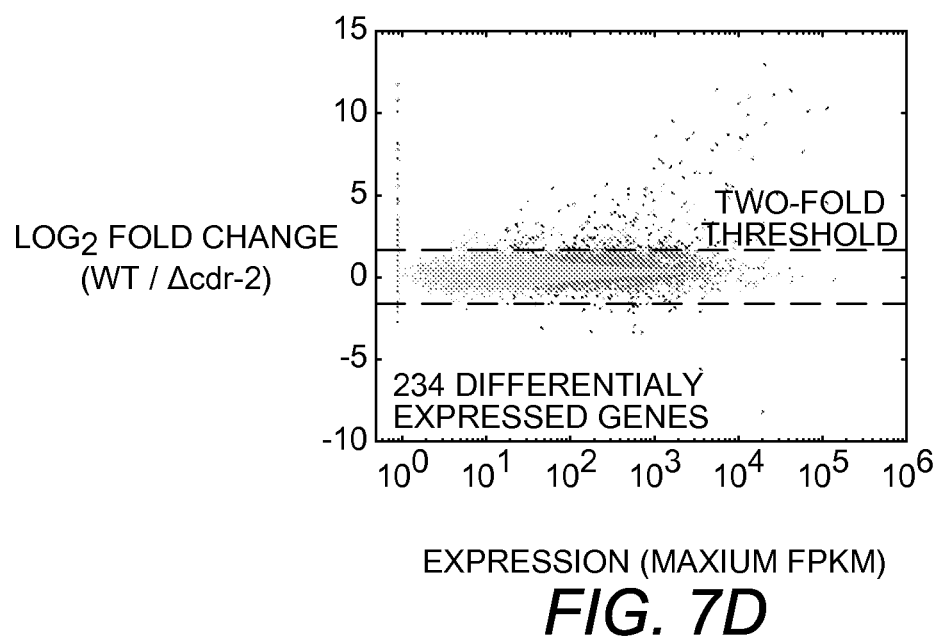
FIG. 7D depicts global expression in Δcdr-2 (Δclr-2) as compared to wild type after transfer to CMM for 4 hrs.
Figure 7E:
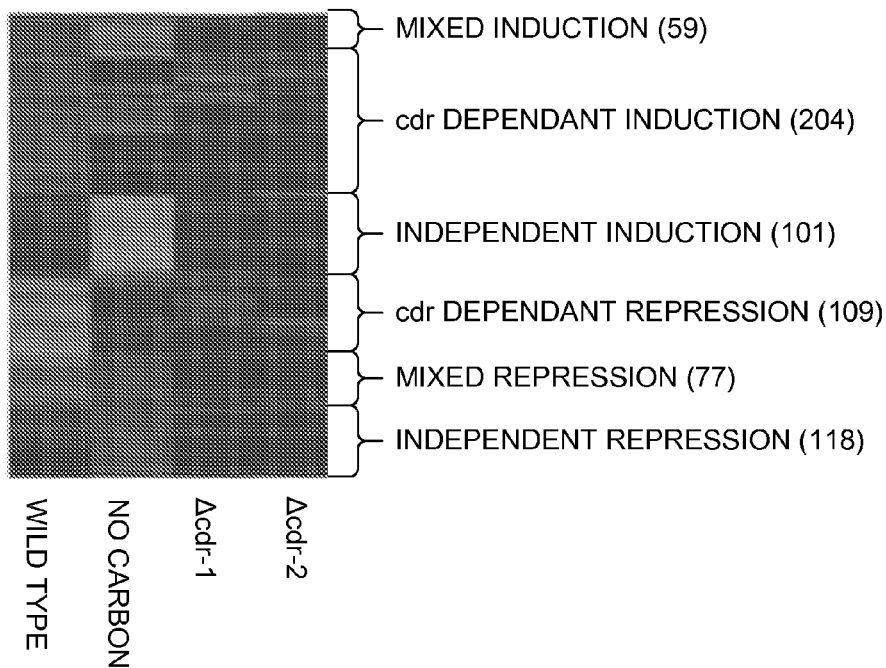
FIG. 7E depicts hierarchical clustering of FPKM at 4 hrs after transfer to CMM for genes identified as differentially expressed in clr mutants and/or in the wild type cellulose to no-carbon comparison.
Figure 7F:
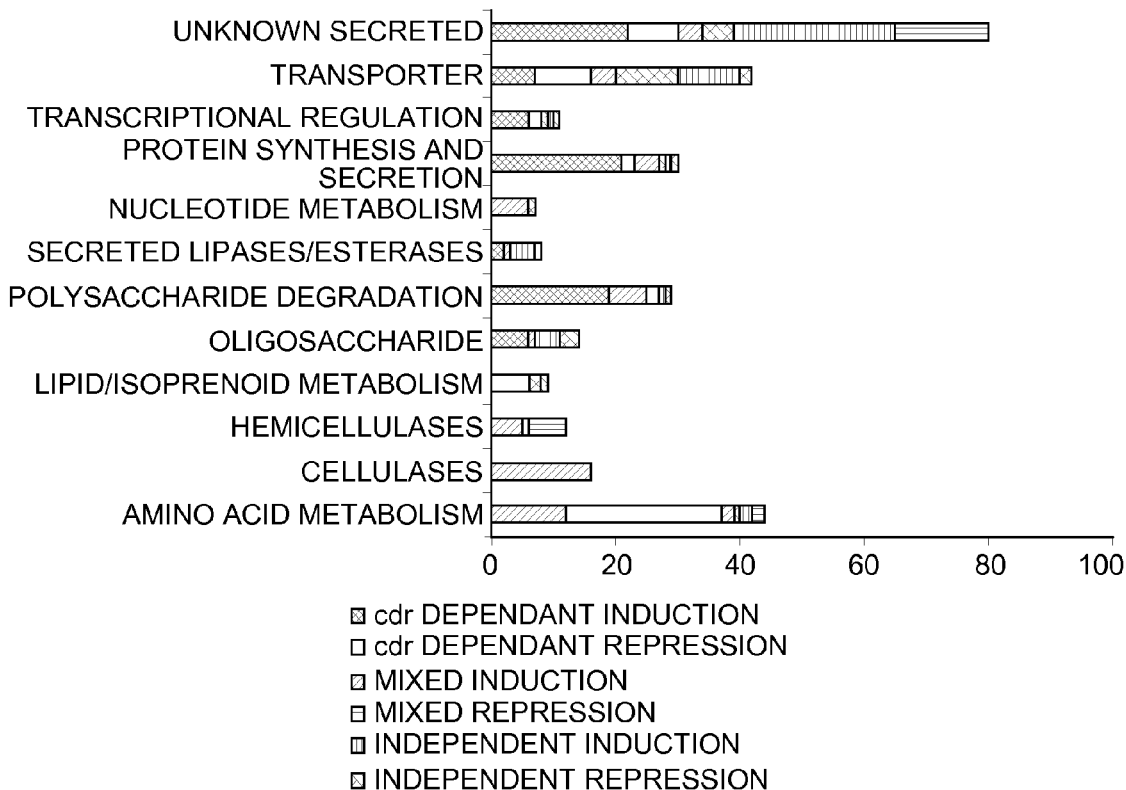
FIG. 7F depicts major classes of genes in the clusters from FIG. 7E.
Figure 7G:
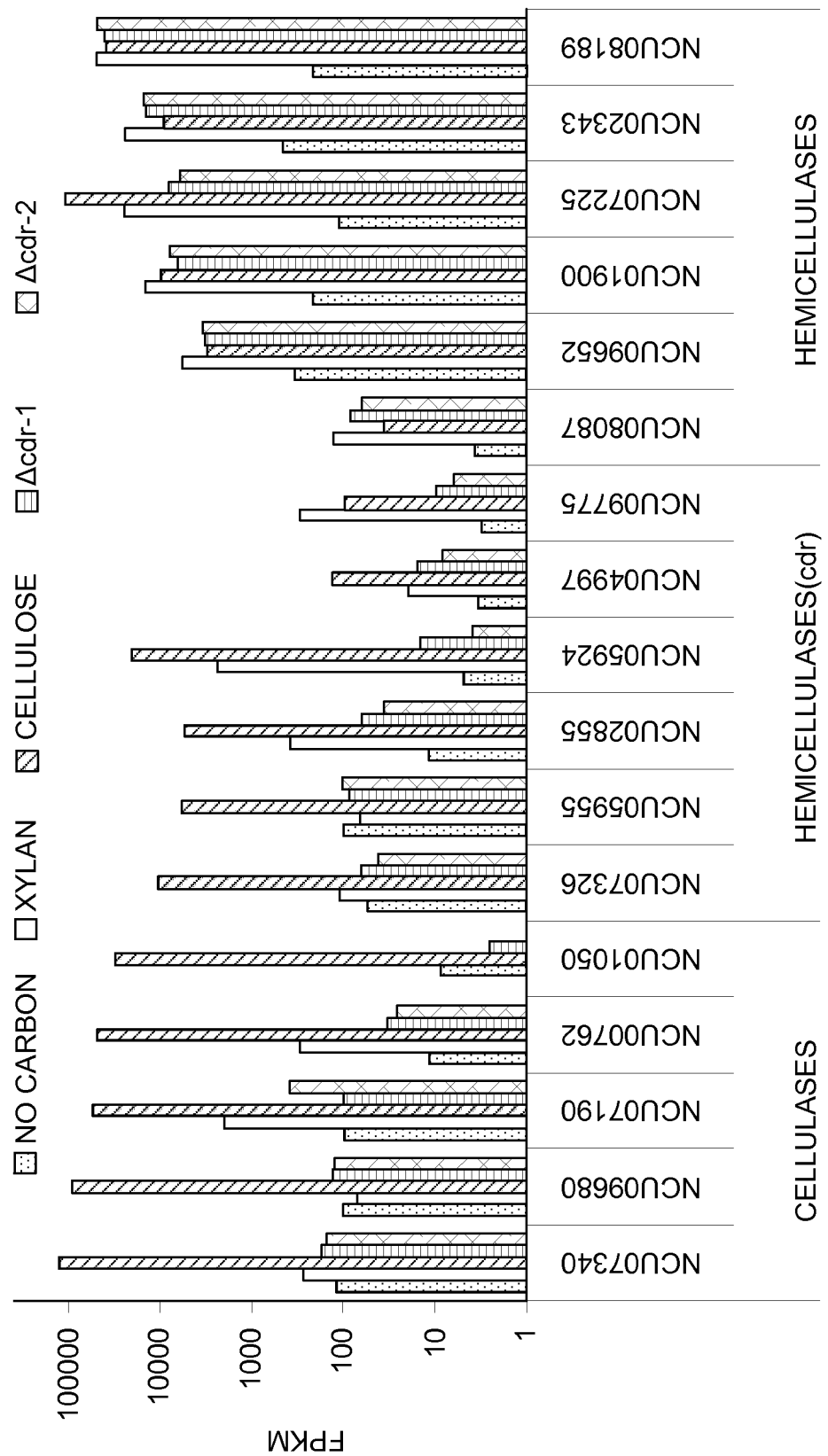
FIG. 7G depicts FPKM of selected cellulases and hemicellulases. Predicted hemicellulases exhibiting cellulase-like expression patterns are regulated by cdr-1 and cdr-2.

Global expression analyses in the Δclr-1 or Δclr-2 mutants transferred to CMM revealed that they show differential expression of a smaller number of cellulose-specific genes identified in a wild type transferred to CMM (cellulose regulon) (FIGS. 7C and 7D). These results indicate that the cellulose regulon includes genes regulated by clr-1 and/or clr-2 as well as some genes under the regulation of an independent mechanism. To delineate the respective regulons, all genes exhibiting differential expression in CMM versus NC conditions or in wild type versus the deletion mutants on CMM were hierarchically clustered by their FPKM values. The resulting clusters indicate that clr-1 and clr-2 share a common regulon that is a major subset of the cellulose induced genes (FIG. 7E). Of the 321 genes that increase in expression level identified in the wild type cellulose regulon (see above), clr-1 and clr-2 are essential for the induction of 204 genes. A further 59 genes required functional clr-1 and clr-2 for increased expression levels, in comparison to wild type. Importantly, the clr-1 and clr-2 regulons almost completely overlap each other (clr regulon). The clr regulon is highly enriched for genes encoding cellulases, polysaccharide active enzymes, transporters and protein synthesis and secretion components with respect to the total cellulose regulon (FIG. 7F). Some, but not all predicted hemicellulases are also under clr regulation. Predicted hemicellulases under clr regulation increase in to a higher expression level after transfer to CMM than transfer to XMM. This cellulase-like expression pattern may indicate that these genes actually encode cellulose active enzymes, or that is advantageous to maintain a group of true hemicellulases under tight co-regulation with cellulases. It should be noted that fungi never encounter pure cellulose without hemicellulose under natural settings.

Example 5

Dependence of Cellobiose Induction on CLR-1 and CLR-2

When fungal cellulases interact with cellulose, cellobiose and glucose are the main soluble products. Without wishing to be bound by theory, it is believed that cellobiose, or a product derived therefrom, is the inducing molecules for fungal cellulases. However, to be utilized, the cellobiose must be hydrolyzed to glucose by beta-glucosidase enzymes. In cultures with pure cellobiose, glucose concentrations quickly rise and cellulase induction is blocked through carbon catabolite repression. Moreover, glucose repression of cellulases is abolished in *N. crassa* strains in which the most highly expressed beta-glucosidase genes (NCU00130, NCU08755 and NCU04952) are deleted (Znameroski et al., Proc Natl Acad Sci USA. 2012 Apr. 17; 109(16):6012-7). This mutant system allows for very specific cellulase induction experiments free of any other signaling molecules that may contaminate Avicel® (crystalline cellulose ~98-99% pure), which is purified from natural plant cell wall material (with ~1-2% hemicellulose contamination).

Figure 10:
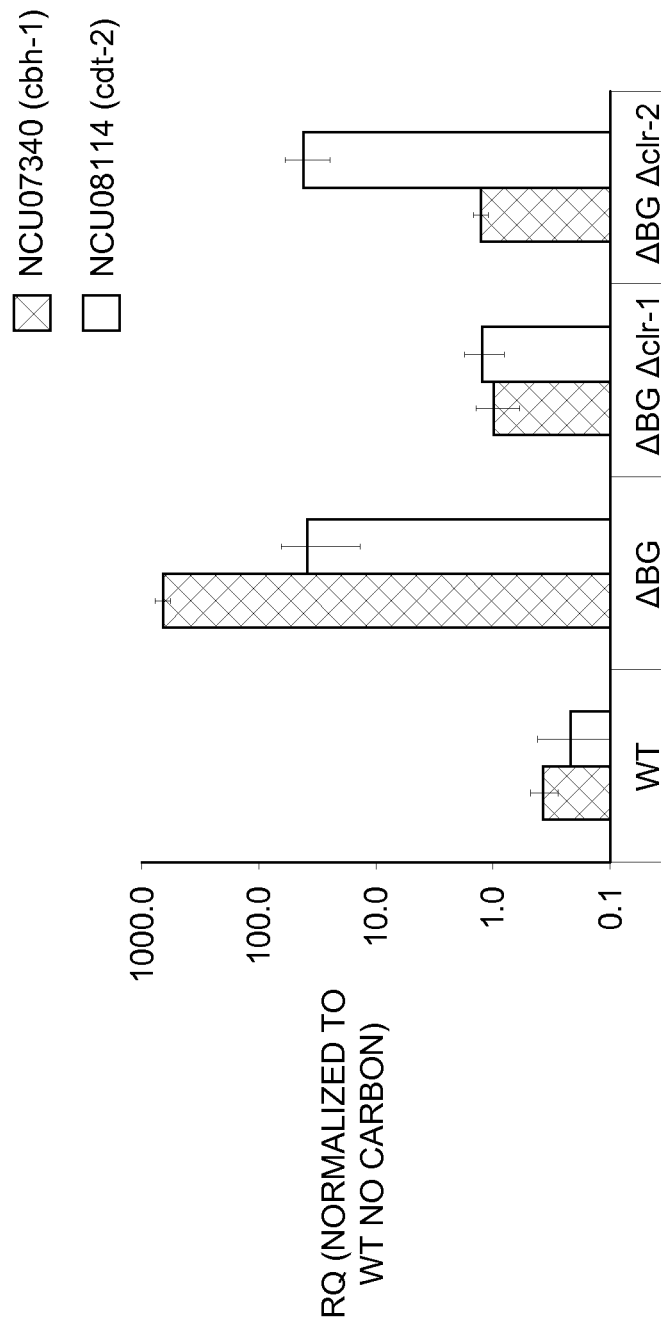
FIG. 10 depicts transcript abundance of cbh-1 and cdt-2 in triple beta-glucosidase deletion mutants (ΔBG) with or without deletion of clr-1 or clr-2 four hours after shift to 0.2% cellobiose.

We generated *N. crassa* mutant strains carrying deletions for the beta-glucosidase genes and for clr-1 or clr-2. When these ΔBG+Δclr mutants were switched from sucrose to cellobiose, the major cellulase cbh-1 was not induced (FIG. 10). These results strongly suggest that cellobiose, or a product derived therefrom, is the signal molecule that activates the clr-1/clr-2 pathway.

Figure 8:
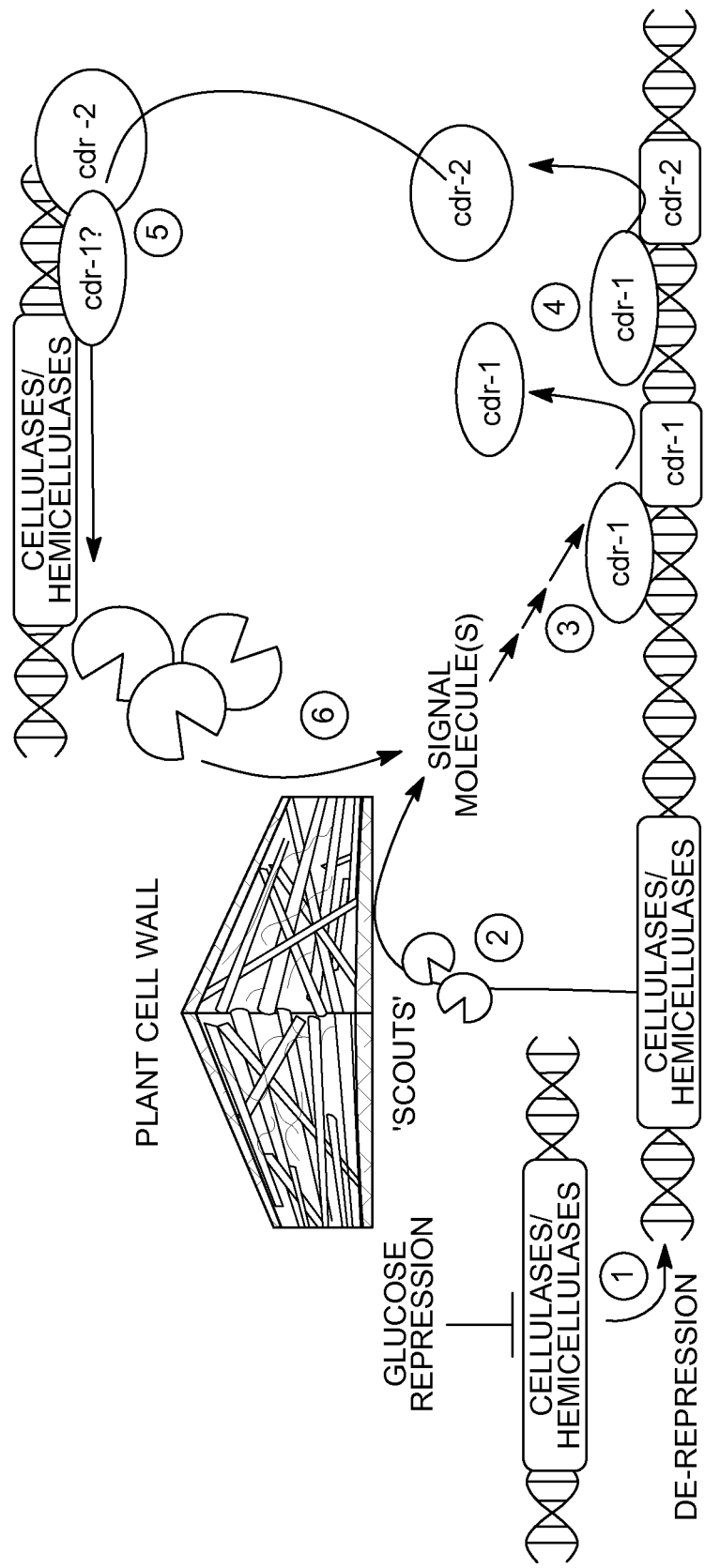
FIG. 8 depicts a non-limiting model for cellulase regulation by cdr-1 (clr-1) and cdr-2 (clr-2). (1) Glucose repression is released. (2) Scout cellulases and hemicellulases degrade plant cell wall material, releasing signal molecules. (3, 4) Signal cascade activates CDR-1 (CLR-1), driving further expression of cdr-1 followed by cdr-2. (5) CDR-2 (CLR-2) and possibly CDR-1 drives expression of the cellulases and some hemicellulases. (6) Cellulases and hemicellulases release more signal molecules, perpetuating the cycle.

In contrast to cbh-1, the cellodextrin transporter cdt-2 is still strongly induced in the ΔBG Δclr-2 mutant. This difference in regulation of cellulase genes and cellobiose utilization genes by clr-1 and clr-2 is consistent with the disclosed model network in which clr-1 is intimately involved in cellobiose detection and utilization but clr-2 only regulates cellulase genes and their secretion (FIG. 8).

Example 6

Effect of Mis-Expression of CLR-1 on Cellulase Expression

Without wishing to be bound by theory, it is believed that clr-1 undergoes post-transcriptional modification or activation in the presence of cellobiose and the absence of repressing carbon sources. Consistent with this belief, it was shown that merely forcing transcription of clr-1 under non-inducing conditions did not result in cellulase production.

We generated a *N. crassa* strain with a GFP tagged copy of clr-1 under control of the ccg-1 promoter at the his-3 locus. The ccg-1 is responsive to the *N. crassa* circadian rhythm and nutrient conditions. For the purposes of these experiments, the ccg-1 promoter served as a constitutive promoter, driving greater clr-1 transcription that is normally seen under rich carbon (sucrose) or starvation conditions and lower clr-1 transcription under Avicel® conditions as seen from the native promoter.

Figure 11A:
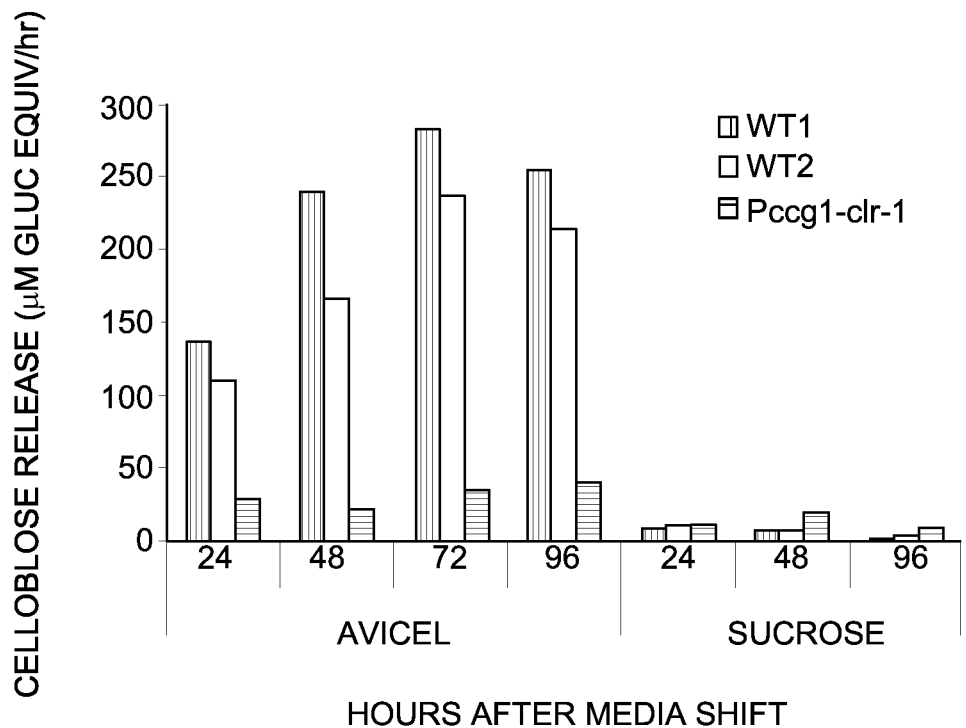
FIG. 11A depicts cellulase activity in culture supernatants as measured by cellobiose release from Avicel®. Cultures were grown 24 hours on sucrose then transferred to fresh media.

Our clr-1 mis-expression strain produces no detectable cellulase activity in sucrose culture. Results from a CMCase enzyme activity experiment are show in FIG. 11A. The results show that the enzyme activity was lower in the mis-expression mutant than in the wild-type strain (FIG. 11A). The mis-expressed clr-1 in this strain was tagged with a C-terminal GFP marker that may reduce its transcriptional efficiently. However, this reduced activity is sufficient for growth on Avicel®.

Figure 11B:
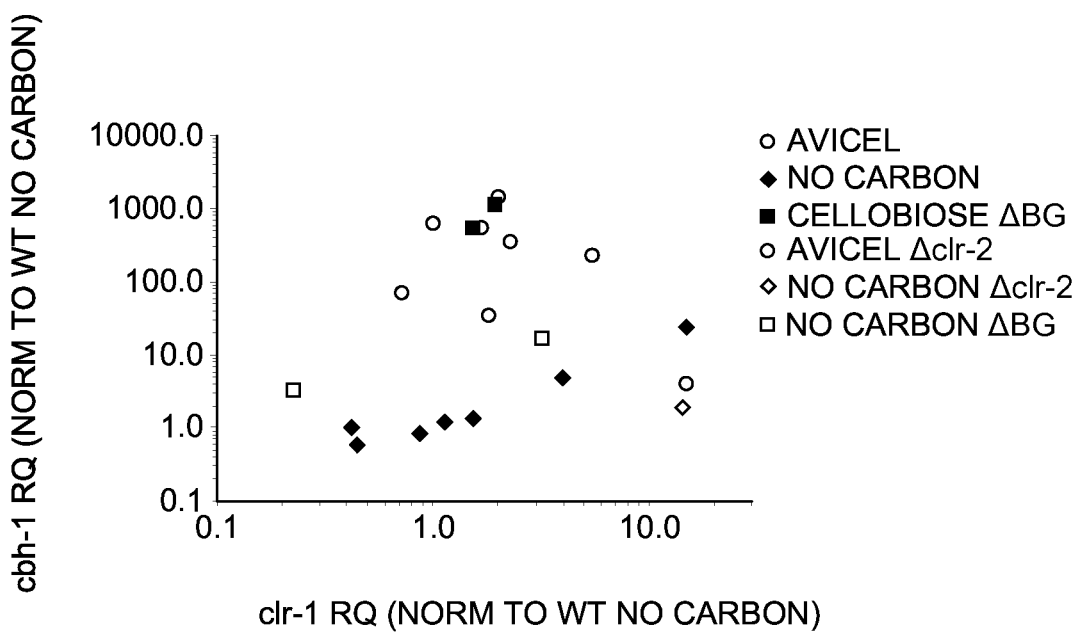
FIG. 11B depicts transcription of cbh-1 as a function of clr-1 abundance. All measurements are by RT-PCR 4 hours after media shift from sucrose cultures.

Further, transcription of the major cellulase cbh-1 showed very poor correlation to clr-1 transcription in both wild type and mutant strains (FIG. 11B). Transcription of cbh-1 correlated with the presence or absence of a cellulase induction by Avicel®, but was not correlated with clr-1 expression levels.

Example 7

Figure 12A:
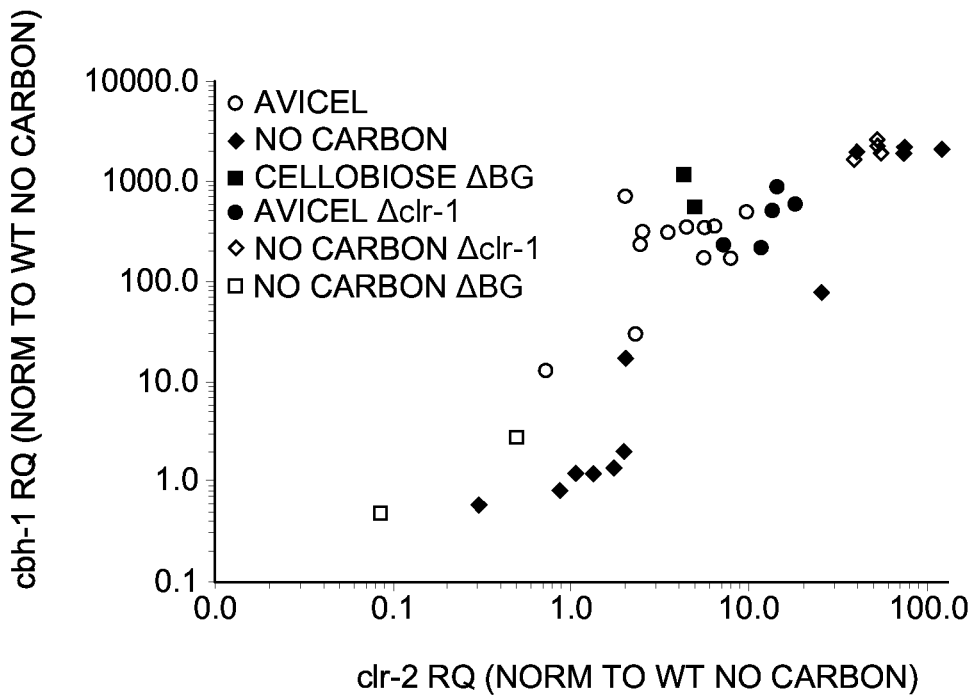
FIG. 12A depicts transcript abundance of cbh-1 relative to clr-2 in *N. crassa* strains 4 hours after shift from sucrose media.

Effect of Mis-Expression of CLR-2 on Cellulase Expression and Activity Under Non-Inducing Conditions We generated *N. crassa* strains expressing clr-2 under control of the ccg-1 promoter at the his-3 locus. Expression of clr-2 under non-inducing conditions was sufficient to induce cellulase gene expression and activity (FIG. 12A). Regardless of media condition, transcript abundance of cbh-1 was directly proportional to clr-2 transcript abundance (FIG. 12A). This proportionality was not dependent on either inducer or a functional copy of clr-1. However, cbh-1 induction was most efficient in the presence of both inducer and a functional copy of clr-1.

Figure 12B:
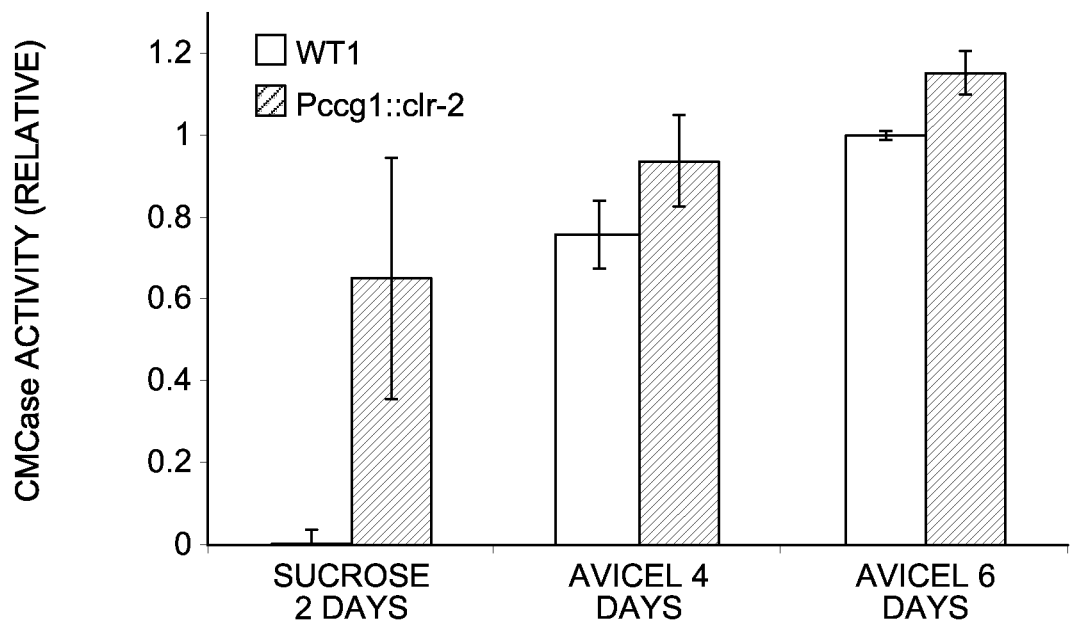
FIG. 12B depicts CMCase activity in WT and clr-2 mis-expression strain supernatants after growth in sucrose or Avicel®.

Transcriptional induction of cellulase genes by clr-2 mis-expression resulted in secretion of active cellulases (FIG. 12B). FIG. 12B shows the results of a CMCase enzyme activity experiment with wild-type (WT) and clr-2 mis-expression strains. The sucrose grown mis-expression strain quickly developed enzymatic activity comparable to that of Avicel® grown WT strains (FIG. 12B).

Figure 12C:
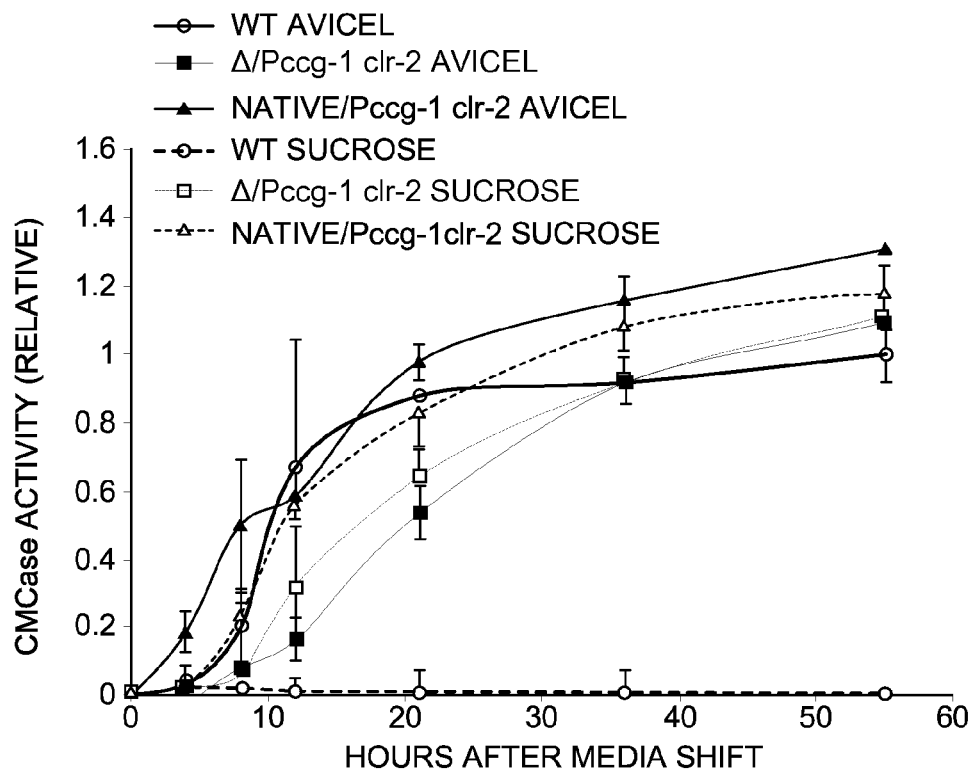
FIG. 12C depicts CMCase activity of clr-2 mis-expression strains after a sucrose grown culture was shifted to fresh media with 2% sucrose or 2% Avicel®.
Figure 12D:
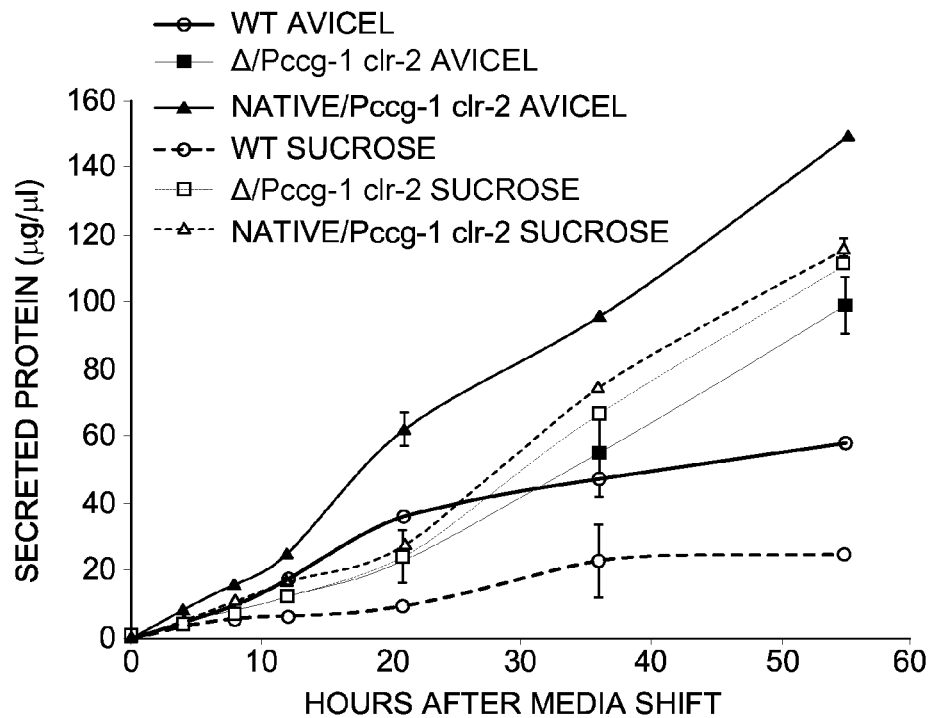
FIG. 12D depicts secreted protein in culture supernatants from clr-2 mis-expression strains after a sucrose grown culture was shifted to fresh media with 2% sucrose or 2% Avicel®.

Consistent with observations that clr-2 transcript abundance and cbh-1 transcript abundance are correlated, mis-expression strains with higher expression levels of clr-2 secreted more protein with greater enzyme activity (FIGS. 12C and 12D). FIGS. 12C and 12D show CMCase enzyme activity and secreted protein from clr-2 mis-expression strains pre-grown in sucrose and shifted to either Avicel® or sucrose media. In the Δ/Pccg1-clr-2 strain, clr-2 is deleted from its native locus and expressed under control of the ccg-1 promoter at the his-3 locus. In the Native/Pccg1-clr-2 strain, the native copy of clr-2 is retained in addition to the ccg-1 driven copy of clr-2 at the his-3 locus.

Figure 13A:
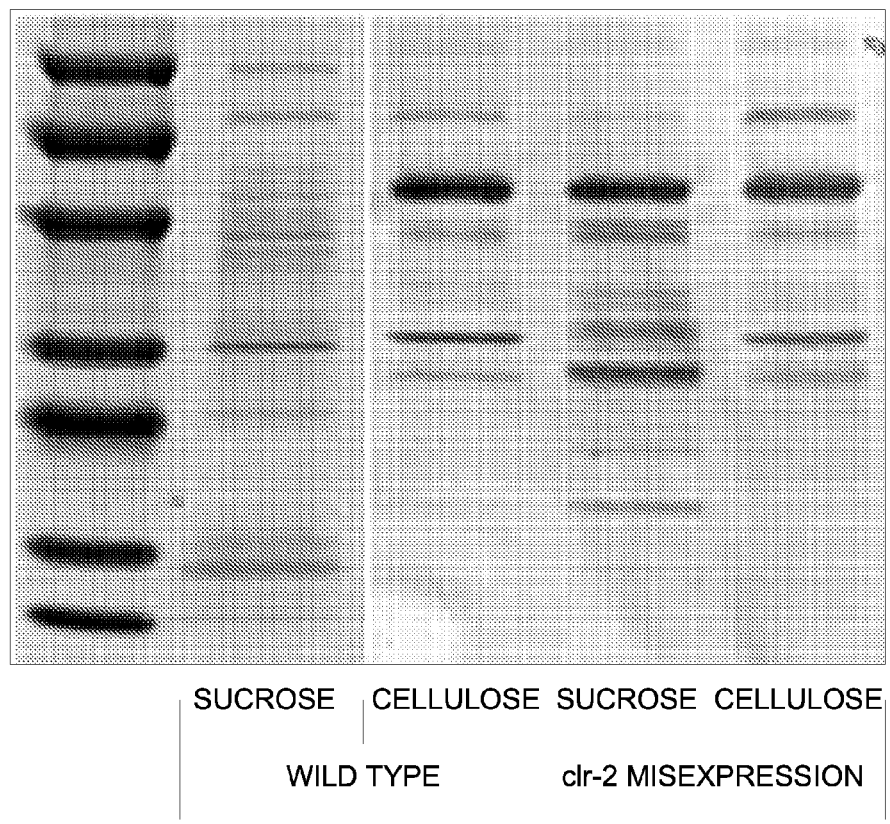
FIG. 13A depicts an SDS-PAGE gel of culture supernatants from WT and clr-2 mis-expression strains.
Figure 13B:
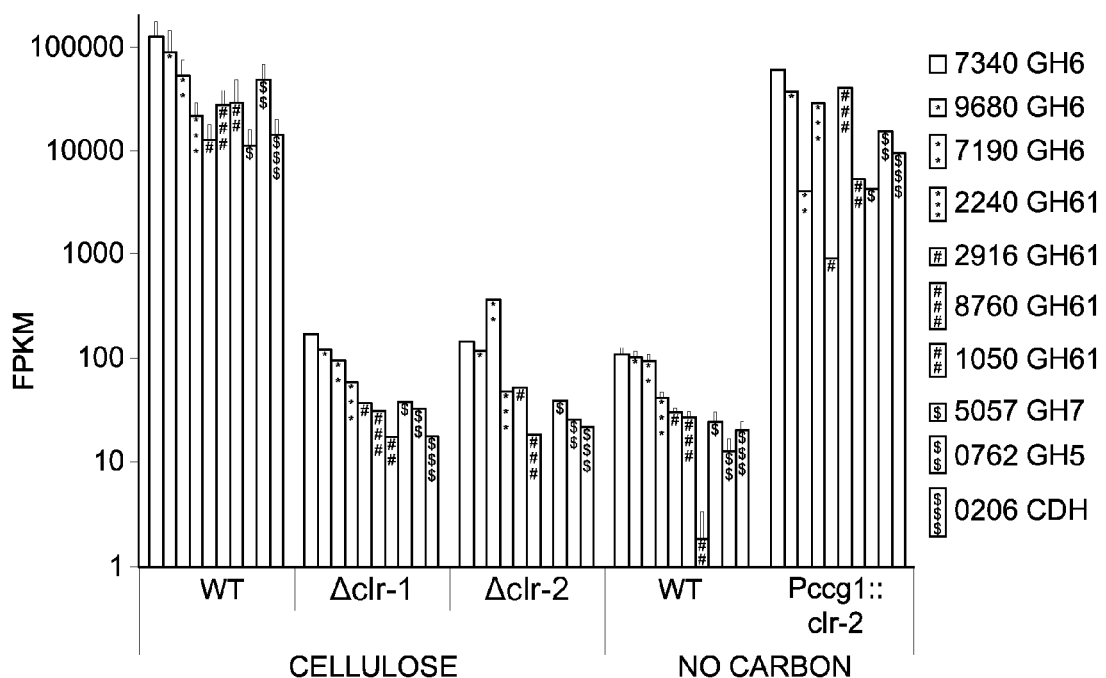
FIG. 13B depicts transcript abundance (RNAseq) of selected cellulase genes in WT *N. crassa*, deletion strains for clr-1 and clr-2 after transfer to Avicel®; and WT and clr-2 mis-expression strains after transfer to no carbon.

Additionally, an SDS-PAGE gel of culture supernatants indicated that the clr-2 mis-expression strain secretes a similar spectrum of enzymes on sucrose as does the WT strain on Avicel® (FIG. 13A). RNAseq analyses of major cellulase transcripts after a media shift from sucrose to no carbon conditions confirmed that enzymes in the clr-2 mis-expression strain were induced to similar levels as in the WT shifted to Avicel® (FIG. 13B).

RNAseq results from the clr-2 mis-expression strain complimented results from a wild-type (WT) *N. crassa* strain in various media conditions. The dr deletion strains on Avicel® and the ΔBG mutants on cellobiose illustrate several modes of transcriptional induction of WT strains on Avicel®. FIG. 14 shows hierarchical clusters of the approximately 200 genes induced by Avicel® in these strains and conditions. Of these genes, approximately one quarter are not induced by cellobiose, but are induced by hemicellulosic contamination of Avicel®, including several hemicellulase and pentose sugar utilization genes (FIG. 14). Of the cellobiose induced genes, all showed some decrease in abundance in the Δclr-1 and Δclr-2 strains on Avicel® and approximately ⅔ were dependent on clr-1 and/or clr-2 (FIG. 14). These genes showed a no carbon-like expression profile in the clr-1 and clr-2 deletion strains on Avicel®. Most of the clr-dependent genes were strongly induced in the clr-2 mis-expression mutant (FIG. 14). One cluster of approximately 50 genes had complex expression patterns indicating some level of modulation of expression by clr-1 and/or clr-2. Among clr-modulated genes, most were more strongly affected in the Δclr-1 deletion strains and had little to no induction in the clr-2 deletion strain. Notable among clr-modulated genes most strongly affected by clr-1 are several genes involved in cellobiose utilization.

Example 8

Condition-Specific Post Translational Modification of CLR-1

Figure 15:
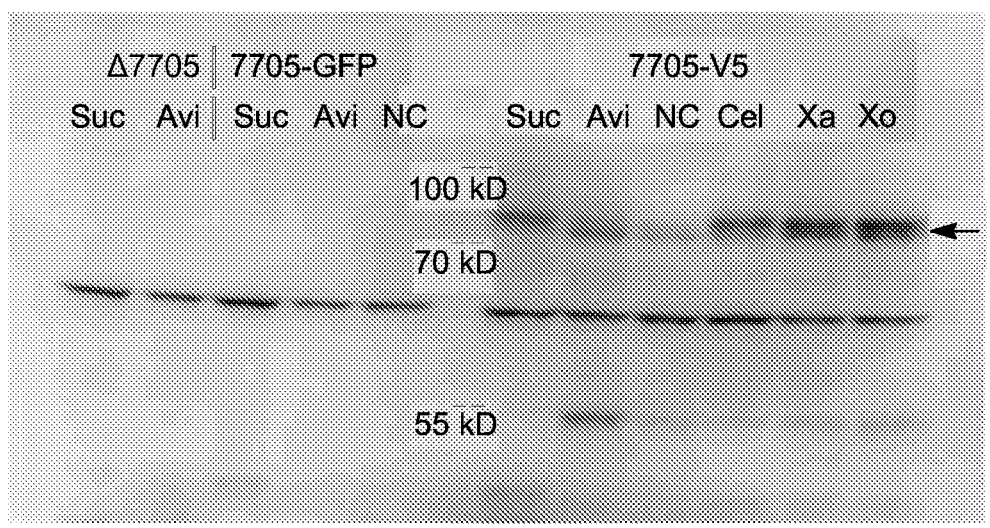
FIG. 15 depicts a Western blot (anti-V5 antibody) of tagged and untagged clr-1 (NCU07705) in *N. crassa* lysates 4 hours after media shift to various carbon sources. Suc refers to sucrose, Avi refers to Avicel®, NC refers to no carbon, Cel refers to cellobiose, Xa refers to xylan, and Xo refers to xylose. The predicted size of the V5 tagged CLR-1 is ~80 kDa. Equal total protein concentrations were loaded per lane.

Without wishing to be bound by theory, it is believed that one way that clr-1 may be activated in response to cellobiose and/or global metabolic state is through post-translational modification. Western blot analysis of V5-tagged clr-1 at its native locus indicated a small but detectable shift in the mature CLR-1 protein when cultures were shifted from sucrose to Avicel® or no carbon conditions (FIG. 15). As shown in FIG. 15, the CLR-1 protein, which is predicted to be 78 kDa, ran in two bands on the gel. The larger band was more abundant in culture shifted to sucrose, cellobiose, xylan and xylose; whereas the smaller band was more abundant in Avicel® and no carbon conditions (FIG. 15). These results suggest that CLR-1 undergoes modification or selective degradation under starvation conditions. Moreover, while clr-1 transcript abundance was much higher under Avicel® conditions than under sucrose conditions, there were comparable amounts of mature CLR-I protein under both of these conditions (FIG. 15). Without wishing to be bound by theory, it is believed that these results suggest that there is increased turnover under starvation conditions.

Example 9

Identification of Direct Targets of CLR-1 and CLR-2

To further characterize the CLR regulons and their DNA binding motifs, chromatin immunoprecipitation (ChIP) was conducted on epitope-tagged CLR-1 and CLR-2 proteins. The experimental setup was similar to the RNAseq media swaps, with *N. crassa* strains grown on minimal media with sucrose for 16 hours then switched to Avicel® for 24 hours. For these experiments, CLR-1 was GFP tagged and under the control of the ccg-1 promoter, and CLR-2 was mCherry tagged and also under the ccg-1 promoter. The subsequent libraries yielded approximately 417 target genes in the CLR-1 ChIPseq library and 318 genes in the CLR-2 library (FIG. 16A).

In order to determine whether CLR-1 and CLR-2 are able to directly control the expression of genes upregulated on cellulose, we compared their ChIP-Seq regulons to the wild-type RNA-Seq regulon containing the 212 genes upregulated on cellulose (FIG. 13B). CLR-1 and CLR-2 together or separately bound to the promoter regions of approximately half the genes induced on Avicel® (FIG. 16A). The CLR proteins did not bind the promoters of genes down-regulated (over 2-fold down) on Avicel® versus no-carbon. These results indicate that CLR-1 and CLR-2 function strictly as transcriptional activators.

Overall, the ChIP-Seq results (FIG. 16A) largely recapitulated the RNA-Seq results (FIG. 13B). The CLR-1 and CLR-2 proteins together bound 40 genes that included a core set of 10 of the most highly expressed cellulase genes along with 2 hemicellulase genes. Additional genes of note within the 40 gene set included xlr-1, a regulator of hemicellulase expression, vib-1 which is involved in secretion, and NCU03184 (flbC) which has reduced growth on Avicel® when deleted.

Figure 16A:
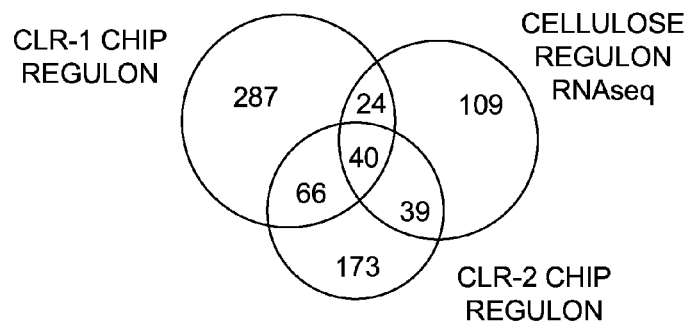
FIG. 16A depicts a Venn Diagram comparing the clr-1/2 ChIPseq regulons to the cellulose response RNAseq regulon.

The large set of CLR-1-bound genes that that are not within the Avicel®/cellulose regulon have enriched functional gene categories that are predicted to be involved with interaction with the environment and signaling (287 gene set, FIG. 16A). These results are consistent with the belief that CLR-1 is specifically involved in sensing of cellobiose in the environment (FIG. 8). The gene set bound only by CLR-2 and not within the Avicel®/cellulose regulon was not enriched for any functional category (173 gene set; FIG. 16A).

Figure 16B:
FIG. 16B depicts a graphical representation of the CLR-1 ChIP-Seq. The grey peaks represent the relative number of reads mapping to several sites within the promoter regions of clr-1 (NCU07705) and clr-2 (NCU08042).

The CLR-1 protein was also found to be bound at the promoters of both the clr-1 and clr-2 genes (FIG. 16B). CLR-1 binding can be seen throughout the clr-2 promoter region including through the annotated hypothetical gene NCU11779 (FIG. 16B). However, as NCU11779 is not expressed in the 200 plus RNA-Seq experiments under a wide variety of conditions, we do not believe that NCU11779 is a protein-encoding gene. These results suggest that CLR-1 binding at the clr-1 and clr-2 promoters provides a positive feedback loop for clr-1 expression and verifies clr-2 as a downstream target of CLR-I.

Figure 16C:
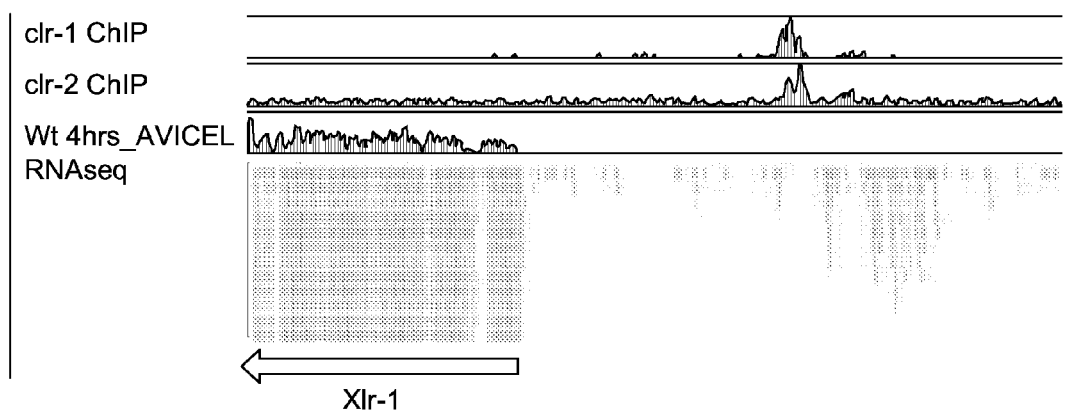
FIG. 16C depicts CLR-1 and CLR-2 ChIP-Seq as well as a 4 hour Avicel® RNA-Seq mapped to the genome. The figure shows the typical ChIP binding pattern of CLR-1 and CLR-2 when they regulate the same gene. CLR-1 and CLR-2 bind to the promoter of xlr-1 in nearly identical places.

Although CLR-1 binds to a large number of cellulose responsive genes, it does not appear to bind to cellulose degrading enzymes by itself; as CLR-2 was always found bound in an adjacent region of these promoters. These results support the hypothesis that CLR-2 is the main activator of cellulases and can drive their expression alone when mis-expressed (FIG. 12). In addition, almost all promoter regions bound by both CLR-1 and CLR-2 overlapped with each other. This result supports the hypothesis that CLR-1 and CLR-2 interact physically at these promoters (FIG. 16C).

Example 10

Figure 17A:
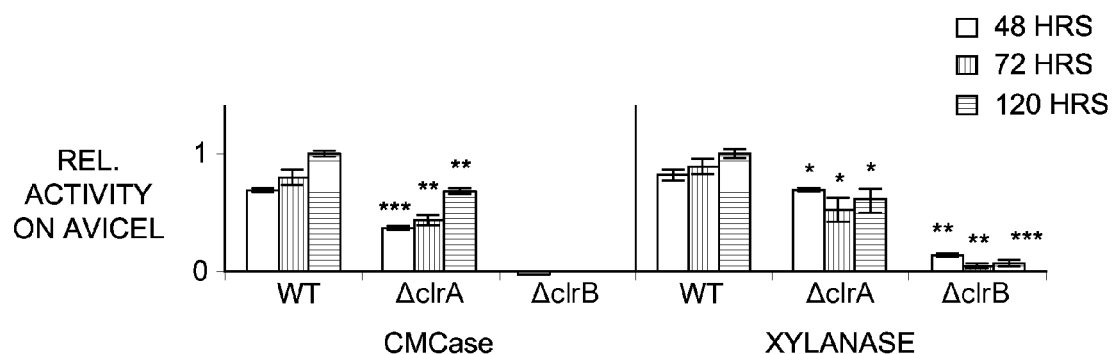
FIG. 17A depicts the enzyme activity of culture supernatants from ΔclrA and ΔclrB mutants grown on glucose and then shifted to Avicel® media.
Figure 17B:
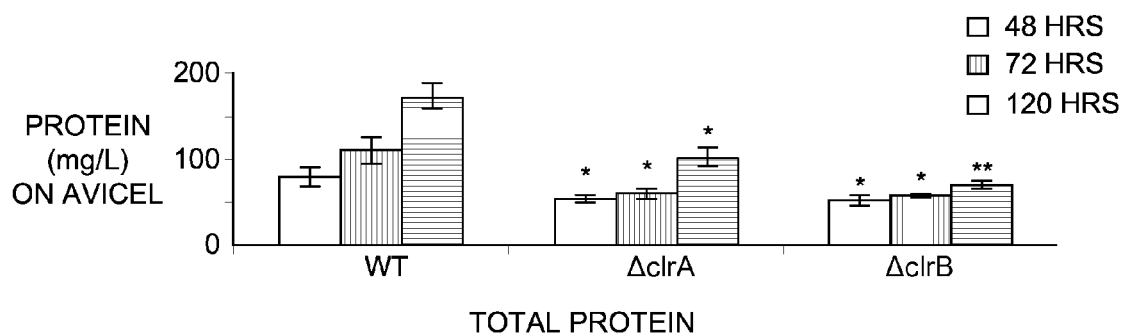
FIG. 17B depicts the total protein in supernatants of cultures grown on Avicel®.
Figure 17C:
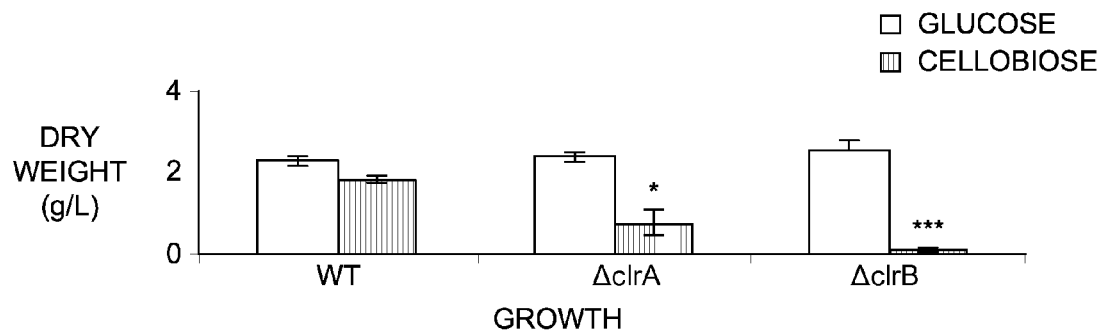
FIG. 17C depicts mycelial dry weights from WT and clr mutants from cultures on glucose and cellobiose (0.5% wt/vol).
Figure 17D:
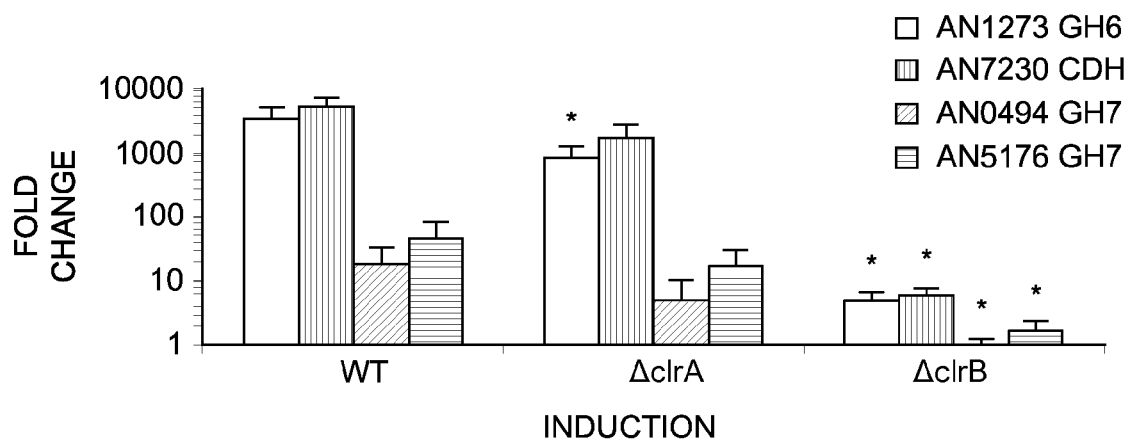
FIG. 17D depicts induction of selected cellulase genes in WT and the cdr mutants following an 8 hr shift to Avicel®, by quantitative RT-PCR. Statistical significance by one tailed, unequal variance t-test. *P<0.05, P<0.01, *P<0.001.

Conservation of CLR Protein Sequences and Function in Filamentous Ascomycete Fungi To assess whether clr-1 and clr-2 homologs function to regulate genes involved in plant cell-wall deconstruction in other filamentous ascomycete species, we generated clr-1 and clr-2 homolog deletion strains in the distantly related fungus *Aspergillus nidulans* in AN5808 (clrA) and AN3369 (clrB). Similar to *N. crassa* Δclr-1 and Δclr-2 mutants, the *A. nidulans* ΔclrA and ΔclrB deletion strains were deficient for cellulase and xylanase activity, as well as total protein secretion when pre-grown glucose cultures were transferred to Avicel® (FIG. 17). Enzyme activity was abolished in the ΔclrB mutant, but the ΔclrA mutant showed ~50% of wild-type (WT) activity (FIGS. 17A and 17B). Both deletion mutants were deficient for growth on cellobiose, although ΔclrB was more strongly affected (FIG. 17C). Consistent with enzyme data, the induction pattern of major cellulase genes in the ΔclrB mutant was several thousand-fold less than WT (FIG. 17D). However, in the ΔclrA mutant the average induction was two- to four-fold less. On a per-gene basis, this decrease was not statistically significant (P<0.05) for three of four tested cellulases (P=0.049, 0.052, 0.105, and 0.121 for AN1273, AN7230, AN0494, and AN5175, respectively), but considering all of the genes together, the null hypothesis that ΔclrA has WT levels of cellulase gene expression was not supported. These results support the conclusion that clrA has a less important role in cellulase induction in *A. nidulans* compared with clr-1 in *N. crassa*. However, the function of CLR-2/ClrB as an essential activator for cellulase gene expression and activity is conserved between *N. crassa* and *A. nidulans*, two of the most widely divergent species of filamentous ascomycete fungi.

Figure 17E:
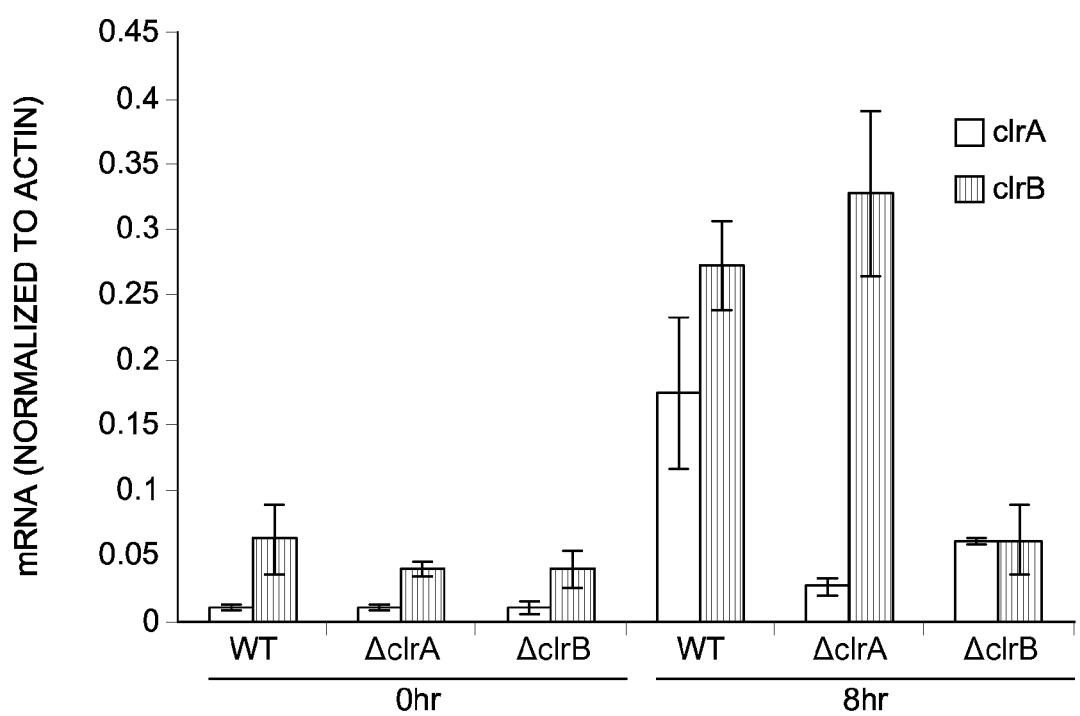
FIG. 17E depicts the expression of clrA and clrB in *Aspergillus nidulans* ΔclrA and ΔclrB mutants after the cultures were exposed to Avicel®. The culture were pre-grown in glucose media for 17 hrs at 37° C. and then shifted to Avicel® media.

Results from RT-PCR analysis showed that the Avicel®-induced expression of clrA on Avicel® was dependent on the presence of clrB, but not vice versa (FIG. 17E). This result suggests that the growth defect of ΔclrB on cellobiose could be an additive effect of reduced expression of clrA and other genes.

Example 11

Mis-Expression of CLRA and CLRB in *Aspergillus nidulans*

Figure 18A:
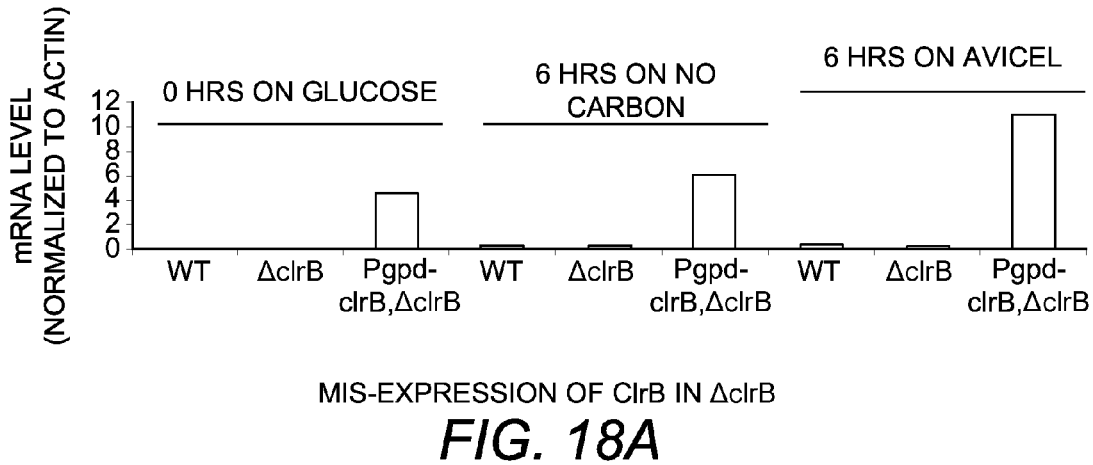
FIG. 18A depicts the expression of the clrB gene in the clrB mis-expression strain. 0 hrs on glucose refers to the time just before shifting the culture grown 17 hr on glucose to media with other carbon source.
Figure 18B:
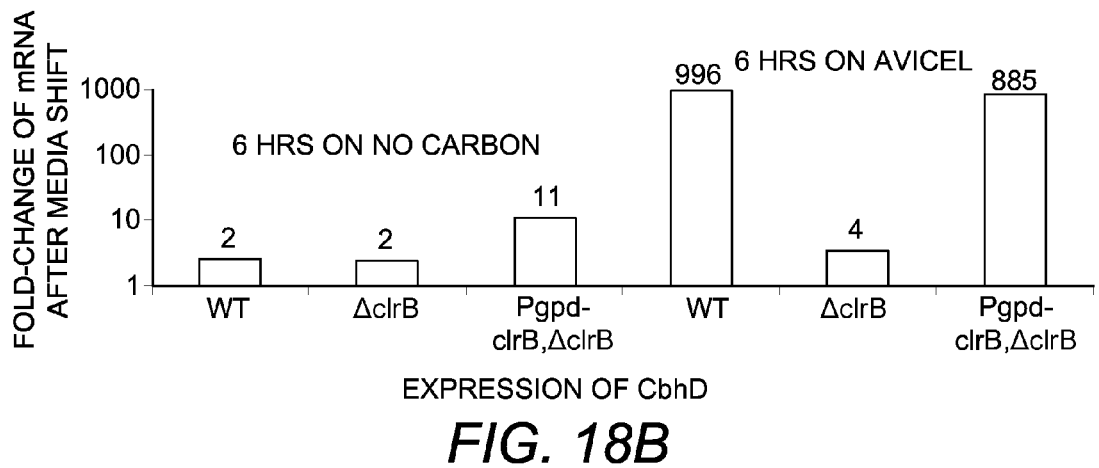
FIG. 18B depicts the expression of the cbhD gene in the clrB mis-expression strain. 0 hrs on glucose refers to the time just before shifting the culture grown 17 hr on glucose to media with other carbon source.
Figure 18C:
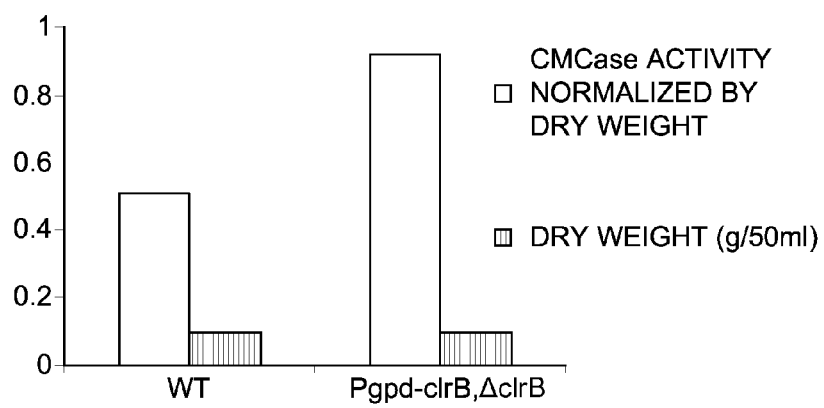
FIG. 18C depicts the growth and CMCase activity of clrB mis-expression strain grown on cellobiose for 48 hrs.

Given the results showing the conservation between clrB and clr-2 as essential factors for cellulase gene expression in both *N. crassa* and *A. nidulans* (FIG. 17) and that mis-expression of clr-2 is sufficient to induce cellulase expression under non-inducing conditions in *N. crassa* (FIG. 12), we decided to test whether mis-expression of clrB in *A. nidulans* can induce cellulase expression. In a ΔclrB *A. nidulans* strain, the clrB gene was put under the control of gpdA promoter and integrated into the genome at the pyrG locus of the ΔclrB strain, with the *A. fumigatus* pyroA gene as a selective marker. FIG. 18A shows that the expression of clrB mRNA in the clrB mis-expression strain was much higher than in the wild-type strain in all conditions tested (glucose, no carbon and Avicel®). As shown in FIGS. 18B and 18C, the mis-expression of clrB restored expression of cbhD on Avicel® and the strain grew as well as wild-type on cellobiose. These results suggest that the mis-expressed ClrB protein is functional. Although the clrB mis-expression strain exhibited a higher CMCase activity than wild-type after growth on cellobiose for 48 hrs (FIG. 18C), no CMCase activity was detected in the clrB mis-expression strain grown on glucose. Moreover, the high mRNA level of clrB in the clrB mis-expression strain on Avicel® did not lead to higher mRNA level of cbhD at 6 hrs (FIGS. 18A and 18B).

Example 12

Expression of CLRA and CLRB in *Neurospora crassa*

Figure 19A:
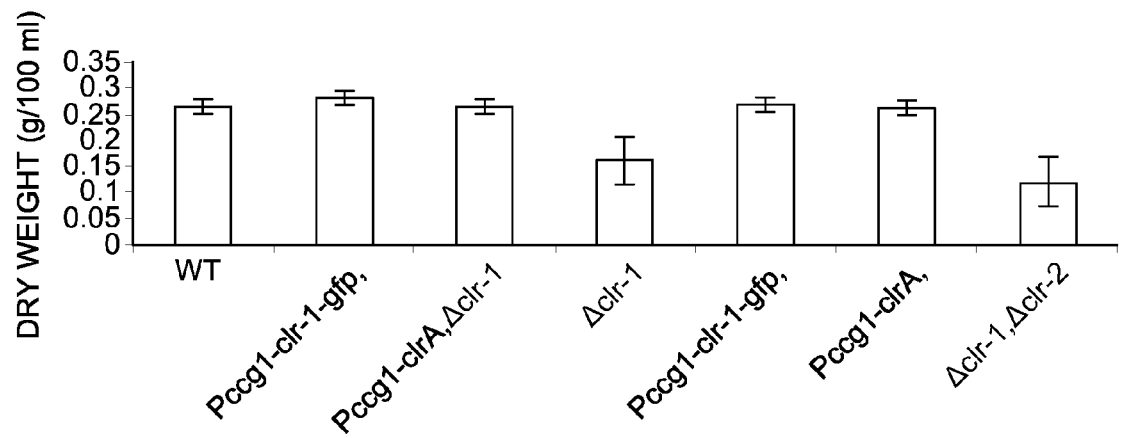
FIG. 19A depicts biomass accumulation of the clrA mis-expression strain on cellobiose.
Figure 19B:
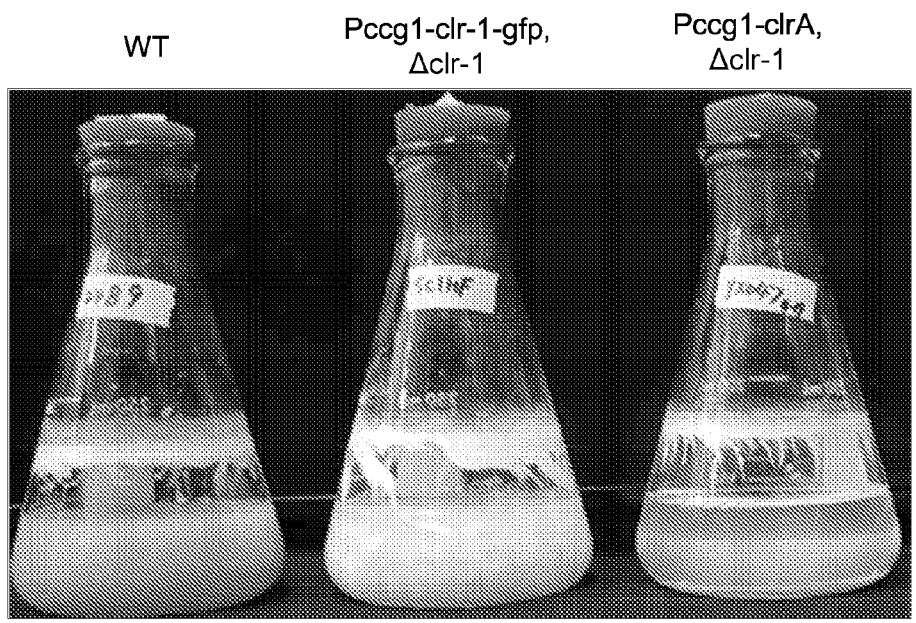
FIG. 19B depicts growth of the clrA mis-expression strain on Avicel®.
Figure 19C:
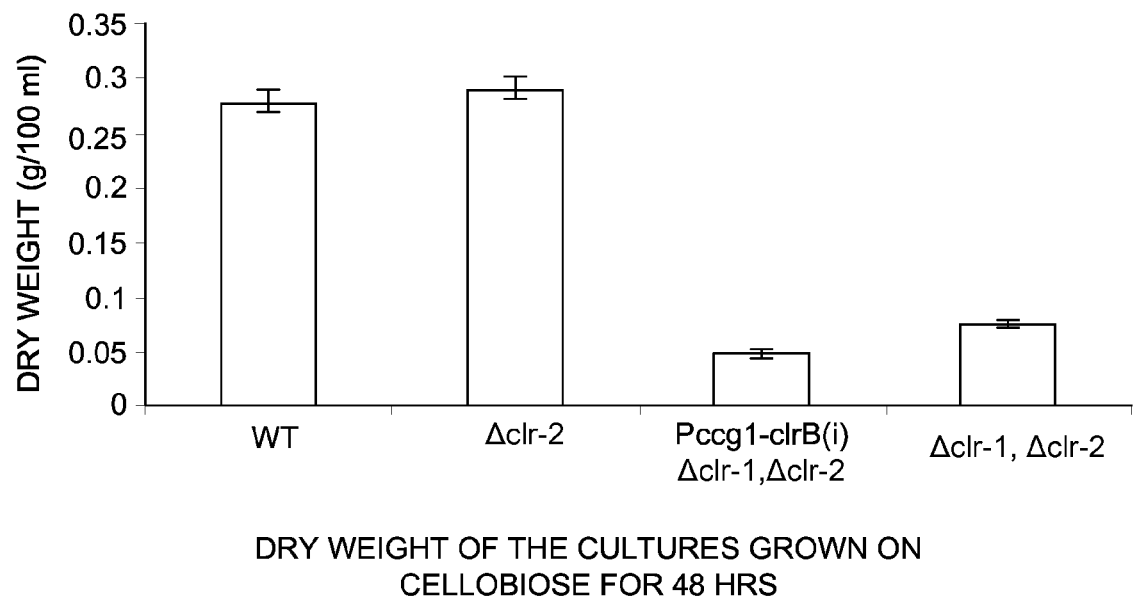
FIG. 19C depicts biomass accumulation of the clrB mis-expression strain on cellobiose.
Figure 19D:
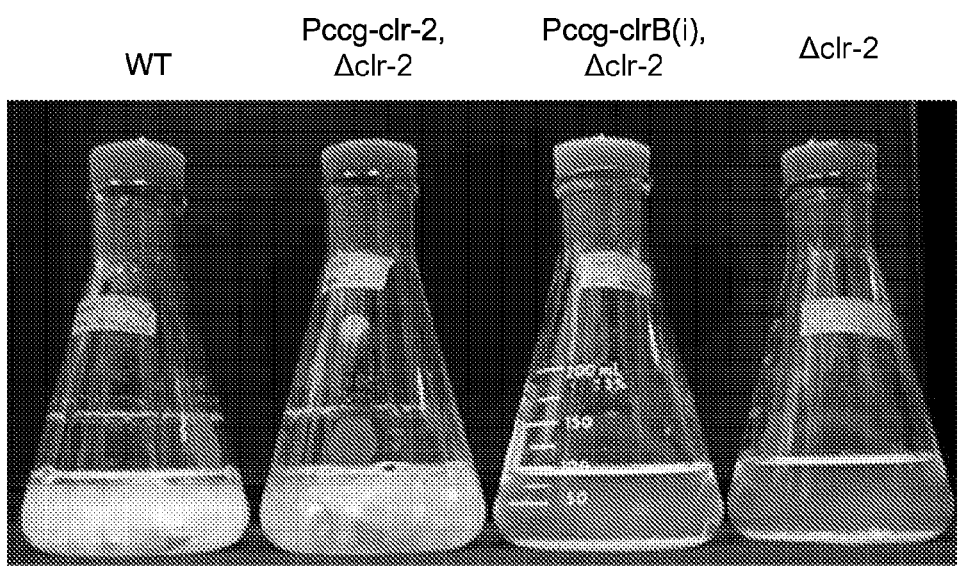
FIG. 19D depicts growth of the clrB mis-expression strain on Avicel®.

Considering the relatively high amino acid sequence similarity of CLR proteins in *A. nidulans* and *N. crassa* (49% identity between clr-1 and clrA, and 32% identity between clr-2 and clrB), we tested whether clrA and clrB could substitute for their homologs in *N. crassa*. A *N. crassa* Δclr-1 strain expressing clrA under the ccg-1 promoter was generated. The Δclr-1 strain expressing clrA retained the severe growth defect on Avicel®, although it accumulated a similar amount of biomass as compared to wild-type on cellobiose (FIGS. 19A and 19B). A *N. crassa* Δclr-2 strain expressing clrB under the ccg-1 promoter was also generated. Although clrB is essential for growth on cellobiose and cellulase gene expression in *A. nidulans*, the mis-expressed clrB did not rescue the growth of *N. crassa* Δclr-2 on either Avicel® or cellobiose (FIGS. 19C and 19D). These results suggest that the function of clr-1/clrA in the cellobiose utilization pathway is conserved between *A. nidulans* and *N. crassa*, but the function of clr-1/clrA and clr-2/clrB in the regulation of Avicel®-specific response may be divergent.

Example 13

DNA-Binding Motifs of *N. crassa* CLR Proteins

Clr-1

Figure 20A:
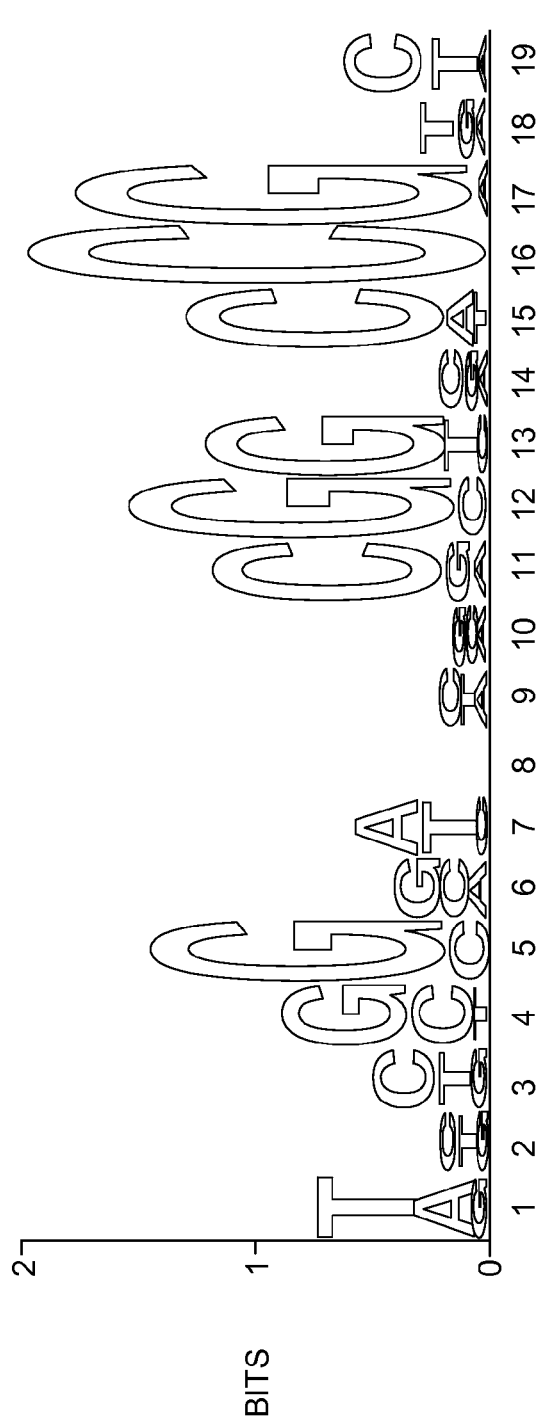
FIG. 20A depicts the Clr-1 DNA-binding motif (SEQ ID NO: 239) as predicted from chromatin immunoprecipitation (ChIP) peaks.

The top 50 CLR-1 chromatin-immunoprecipitation peaks, which were identified by sequence analysis (ChIP-Seq; promoter regions most frequently immunoprecipitated by antibody to epitope-tagged CLR-1), were searched for a characteristic DNA binding motif. The peaks were searched using the program MEME (Multiple Em for Motif Elicitation) and resulted in the motif depicted in FIG. 20A, for a consensus binding site for CLR-1 in promoters of target genes. This motif has the characteristic inverted CGG repeats that is commonly found in this class of transcription factors. One of the important characteristics of the CGG inverted repeat is the spacing between them, which helps determine which transcription factors can bind to the location. The CLR-1 motif is separated by a single non-conserved nucleotide. This spacing has been seen in other transcription factors, but none with a related function.

Clr-2

Figure 20B:
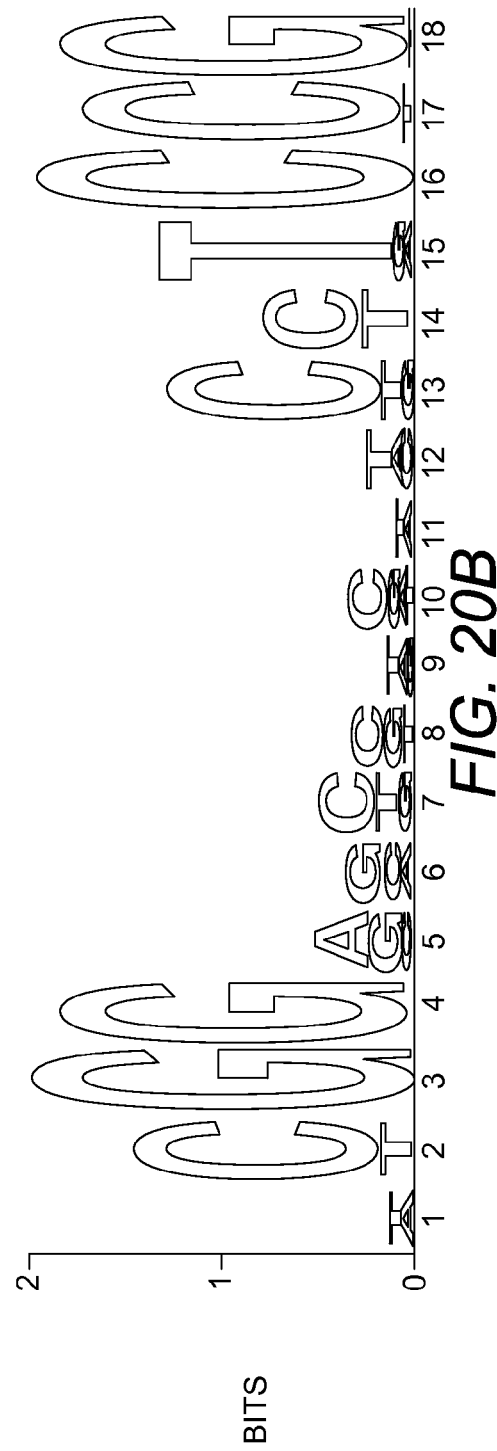
FIG. 20B depicts the Clr-2 DNA-binding motif (SEQ ID NO: 240) as predicted from chromatin immunoprecipitation (ChIP) peaks.

The top CLR-2 chromatin-immunoprecipitation peaks, which were identified by sequence analysis (ChIP-Seq; promoter regions most frequently immunoprecipitated by antibody to epitope-tagged CLR-2), were searched for a characteristic DNA binding motif. The peaks were searched using the program MEME (Multiple Em for Motif Elicitation) and resulted in the motif depicted in FIG. 20B, for a consensus binding site for CLR-2 in promoters of target genes. This motif has the characteristic inverted CGG repeats that is commonly found in this class of transcription factors. One of the important characteristics of the CGG inverted repeat is the spacing between them, which helps determine which transcription factors can bind to the location. The CLR-2 motif is separated by 11 non-conserved nucleotides. This spacing is the same as for the *Saccharomyces cerevisiae* Gal4 motif, the closest yeast homolog to CLR-2. There are 50 motif binding sites within the CLR-2 ChIP regulon with the predicted DNA binding motif, this number was increased to 84 with the simplified version of CCG(N11)CGG.

Example 14

CLR Protein Sequence Analysis

Clr-1

The *N. crassa* clr-1 amino acid sequence was aligned with 22 other clr-1 homologs to identify conserved motif sequences (FIG. 21). Sequences were aligned with the MAFFT alignment algorithm (available from the CBRC mafft website). Alignments were manually inspected for regions of conservation outside of known conserved domains in likely orthologs (as determined by phylogenetic analysis), but which were not well conserved in the nearest non-clr-1 paralogs in *N. crassa* and *A. nidulans*. The consensus sequence was determined with the Jalview software suite.

As shown in FIG. 21, the sequence alignment identified the zinc(2)-cysteine(6) binuclear cluster domain, which is conserved in members of the fungal specific zinc binuclear cluster superfamily, at amino acids 220-275 of the consensus sequence shown at the bottom of the figure. The conserved zinc(2)-cysteine(6) binuclear cluster domain had the following sequence: C-E-V-C-R-S-R-K-S-R-C-D-G-T-K-P-K-C-K-L-C-T-E-L-G-A-E-C-I-Y-R-E (SEQ ID NO: 235).

The sequence alignment also identified the fungal-specific transcription factor PFAM04082 conserved central domain at amino acids 435-760 of the consensus sequence (FIG. 21). The PFAM04082 transcription factor domain had the following sequence: I-E-A-Y-F-E-R-V-N-V-W-Y-A-C-V-N-P-Y-T-W-R-S-H-Y-R-T-A-L-S-N-G-F-R-E-G-P-E-S-C-I-V-L-L-V-L-A-L-G-Q-A-S-L-R-G-S-I-S-R-I-V-P-X-E-D-P-P-G-L-Q-Y- F-T-A-A-W-X-L-L-P-G-M-M-T-X-N-S-V-L-A-A-Q-C-H-L-L-A-A-A-Y-L-F-Y-L-V-R-P-L-E-A-W-N-L-L-C-T-T-S-T-K-L-Q-L-L-L-M-A-P-N-R-V-P-P-X-Q-R-E-L-S-E-R-I-Y-W-N-A-L-L-F-E-S-D-L-L-A-E-L-D-L-P-H-S-G-1-V-Q-F-E-E-N-V-G-L-P-G-G-F-E-G-E-E-D-E-X-D-E-E-A-D-X-D-Q-E-I-A-X-V-T-A-V-G-R-D-E-L-W-Y-F-L-A-E-I-A-L-R-R-L-L-N-R-V-S-Q-L-I-Y-S-K-D-T-P-Y-S-K-G-P-S-M-A-S-T-T-S-L-E-P-I-V-A-E-L-D-F-Q-L-T-Q-W-Y-E (SEQ ID NO: 237), where X can be any amino acid residue.

Additionally, the sequence alignment identified five conserved sequence motifs that can be used to identify clr-1 transcription factors (FIG. 21). The first conserved motif was identified at amino acids 258-274 of the consensus sequence and has the following sequence: A-G-D-[KR]-[LM]-I-[LI]-[ED]-[RKQH]-L-N-R-I-E-[SNG]-L-L (SEQ ID NO: 188). The second conserved motif was identified at amino acids 851-867 of the consensus sequence and has the following sequence: H-[HR]-[ADE]-G-H-[MLI]-P-Y-[IL]-[WF]-Q-G-A-L-S-[MI]-[VMI](SEQ ID: 189). The third conserved motif was identified at amino acids 166-180 of the consensus sequence and has the following sequence: [NP]-[PS]-[LKTS]-K-[RK]-[RK]-[NSP]-[TSN]-[EDST]-X-X-[VIAT]-[DE]-Y-P (SEQ ID NO: 190), where X can be any amino acid residue. The fourth conserved motif was identified at amino acids 330-340 of the consensus sequence and has the following sequence: G-G-[FLIS]-G-[TSG]-[WAH]-X-W-P-[PA]-[TS] (SEQ ID NO: 191). The fifth conserved motif was identified at amino acids 104-111 of the consensus sequence and has the following sequence: R-[NH]-[LM]-[ST]-[QP]-[STP]-[SP]-[DE] (SEQ ID NO: 192).

Clr-2

The *N. crassa* clr-2 amino acid sequence was aligned with 21 other clr-2 homologs to identify conserved motif sequences (FIG. 22). Sequences were aligned with the MAFFT alignment algorithm (available from the CBRC mafft website). Alignments were manually inspected for regions of conservation outside of known conserved domains in likely orthologs (as determined by phylogenetic analysis), but which were not well conserved in the nearest non-clr-1 paralogs in *N. crassa* and *A. nidulans*. The consensus sequence was determined with the Jalview software suite.

As shown in FIG. 22, the sequence alignment identified the zinc(2)-cysteine(6) binuclear cluster domain, which is conserved in members of the fungal specific zinc binuclear cluster superfamily, at amino acids 65-110 of the consensus sequence shown at the bottom of the figure. The conserved zinc(2)-cysteine(6) binuclear cluster domain had the following sequence: C-A-E-C-R-R-R-K-I-R-C-D-G-E-Q-PC-G-Q-C-X-W-Y-X-K-P-K-R-C-F-Y-R-V-X-P-S-R-K (SEQ ID NO: 236), where X can be any amino acid residue.

The sequence alignment also identified the fungal-specific transcription factor PFAM04082 conserved central domain at amino acids 368-555 of the consensus sequence (FIG. 22). The PFAM04082 transcription factor domain had the following sequence: I-D-A-Y-F-K-R-V-H-X-F-X-P-M-L-D-E-X-T-F-R-A-T-Y-L-E-G-Q-R-K-D-A-P-W-L-A-L-L-N-M-V-F-A-L-G-S-I-A-A-M-K-S-D-D-Y-N-H-X-X-Y-N-R-A-M-E-H-L-X-L- D-S-F-G-S-S-H-X-E-T-V-Q-A-L-A-L-M-G-G-Y-Y-L-H-Y-I-N-R-P-N-X-A-N-A-L-M-G-A-A-L-R-M-A-S-A-L-G-L-H-R-E-S-L-A-Q-X-X-A-S-S-Q-K-G-V-N-X-S-D-X-A-S-A-E-T-R-R-R-T-W-W-S-L-F-C-L-D-T-W-A-T-T-T-L-G-R-P-S-X-G-R-W-G (SEQ ID NO: 238), where X can be any amino acid residue.

Additionally, the sequence alignment identified four conserved sequence motifs that can be used to identify clr-2 transcription factors (FIG. 22). The first conserved motif was identified at amino acids 140-152 of the consensus sequence and has the following sequence: [VL]-[ED]-[KAE]-L-S-[QTSN]-[STN]-[LVI]-[DE]-[DE]-[YC]-[RK]-[STV] (SEQ ID NO: 184). The second conserved motif was identified at amino acids 800-818 of the consensus sequence and has the following sequence: [MLI]-[STI]-G-W-N-A-V-W-[FLW]-[IVLCT]-[FY]-Q-[AS]-X-[ML]-[VI]-P-L-[ILV] (SEQ ID: 185), where X can be any amino acid residue. The third conserved motif was identified at amino acids 614-619 of the consensus sequence and has the following sequence: [ED]-X-L-[AV]-[AVI]-[STAL] (SEQ ID NO: 186), where X can be any amino acid residue. The fourth conserved motif was identified at amino acids 14-19 of the consensus sequence and has the following sequence: M-[FY]-[HIL]-T-F-[QE] (SEQ ID NO: 187).

Materials & Methods for Examples 1-14 Include

Strains

The wild-type reference strain and background for all *N. crassa* mutant strains was FGSC 2489 (*Neurospora crassa* 74-OR23-1V A). Deletion strains for clr-1 and clr-2 with their open reading frames replaced by a hygromycin resistance cassette (FGSC 11029 and FGSC 15835 respectively) were obtained from the Fungal Genetics Stock Center at the University of Missouri, Kansas City, Mo. The wild-type *A. nidulans* reference strain was FGSC 4A. Gene deletions in *A. nidulans* were carried out by transforming FGSC A1149 (pyrG89; pyroA4; nkuA::argB) with knockout cassettes obtained from the Fungal Genetics Stock Center at the University of Missouri, Kansas City, Mo.

Transformants were crossed to LO1496 (fwA1, pyrG89, nicA2, pabaA1, from Berl R. Oakley Department of Molecular Biosciences, University of Kansas, Lawrence, Kans.) to remove nkuA::argB and pyroA4.

Culture Conditions for Media Shift Assay

*N. crassa* strains were inoculated into 3 mL agar slants with Vogel's minimal media (2% sucrose as carbon source; SMM) and grown at 30° C. in the dark for 48 hours, then at 25° C. in constant light for 4-10 days to stimulate conidia production. Suspended conidia were then inoculated into 100 mL of Vogel's minimal media at 106 conidia/mL and grown 16 hours at 25° C. in constant light and agitation. The mycelial cultures were then centrifuged at 3400 rpm for 10 min at room temperature and washed with Vogel's minimal media (VMM) without a carbon source. Washed mycelia were re-suspended in 100 mL Vogel's with 2% carbon source (cellulose or hemicellulose). The cellulose used in all experiments was Avicel® PH-101 (Sigma Aldrich, Mo.). The model hemicellulose used was Beechwood Xylan (Sigma Aldrich, Mo.).

*A. nidulans* cultures were grown on minimal media (MM). Carbon sources were 1% wt/vol unless otherwise noted. Conidia were inoculated into 100 mL liquid media at 4×106 conidia/mL and grown at 37° C. in constant light and shaking (200 rpm). *A. nidulans* cultures were grown 16-17 hr on MM-glucose. A 15 mL sample was taken at time 0. The remaining culture was filtered through miracloth, washed, and transferred to 100 mL MM containing 1% Avicel®. RNA was extracted as above and mRNA abundance was compared between the 8 hr and time 0 samples by quantitative RT-PCR. Fold-induction was calculated as the ratio of the mRNA level normalized to act A at 8 h vs. act A at time 0. For enzyme activity assays, culture supernatants were sampled at 48-120 hr, centrifuged at 2,390×g twice to remove mycelia and stored at 4° C. for analysis.

For RNA expression profiling, cultures were sampled post-transfer at 30 minutes, 1 hr, 2 hrs and 4 hrs. Mycelia samples were collected by filtering onto WHATMAN™ paper and were immediately flash-frozen in liquid nitrogen. Total RNA was extracted as described in (Kasuga et al., Nucleic Acids Res., 33: 6469-6485 (2005)).

For enzyme activity assays, culture supernatants were sampled at 24 hours, filtered with WHATMAN™ paper and stored at 4° C. for analysis within 72 hrs.

RNA Sequencing

RNA samples were reverse transcribed and prepared for high throughput sequencing with protocols adapted from Illumina Inc. Briefly, mRNA was purified with DYNA-BEADS™ Oligo dT magnetic beads (Illumina). Purified mRNA was fragmented with buffered zinc solution from Ambion (Cat #AM8740). First and second strand cDNA synthesis was carried out using Superscript II Reverse Transcriptase (Invitrogen) and DNA pol I (Invitrogen) and random primers. Illumina sequencing adapters were then ligated to the cDNA, 200 bp fragments were purified by gel electrophoresis, and PCR enriched with Pfx DNA polymerase (Invitrogen). Libraries were sequenced on the HiSeq 2000 DNA sequencing platform at the Vincent J. Coates Genomics Sequencing Laboratory at the California Institute for Quantitative Biosciences, Berkeley Calif. Approximately 60 million single end 50 base-pair reads were obtained per library.

Analysis of Differential Expression

To establish biological variation, triplicate cultures were sampled and analyzed for the wild type strain on cellulose and sucrose at 1 hour and 4 hours after the media shift. For all other strains and conditions, a single RNAseq library was analyzed.

Sequenced libraries were mapped against predicted transcripts from the *N. crassa* OR74A genome (version 10) with Bowtie (Langmead et al., (2009) Genome Biol 10:R25). Transcript abundance was estimated with Cufflinks using upper quartile normalization and mapping against reference isoforms from the Broad Institute. Genes exhibiting statistically significant expression changes between strains or growth conditions were identified with Cuffdiff, using upper quartile normalization and a minimum raw count of 5 reads (Roberts A, Trapnell et al., (2011) Genome Biology. 12:R22). The genes identified by Cuffdiff were then filtered to select only those exhibiting a two-fold change in estimated abundance between all biological replicates of each strain/condition tested and only those genes with an FPKM consistently above 5 in at least one strain/condition were considered significant.

To compare genes exhibiting altered expression in clr mutants to those exhibiting altered expression in response to cellulose, genes were hierarchically clustered by their FPKMs in the wild type strain on cellulose, wild type on no-carbon and in the Δclr-1 and Δclr-2 strains on cellulose, all at 4 hours after media shift. Prior to clustering, FPMKs were log transformed, normalized across strains/conditions on a per-gene basis and centered on the median value across strains/conditions.

Enzyme Activity Assays

To assess total cellulase activity, 500 μL of culture supernatant was incubated with 2.5 mg cellulose in 500 μL of 100 mM sodium acetate, pH 5 for 5 hours at 37° C. 40 μL of incubated sample was then added to 160 μL assays solution containing dianisidine, peroxidase and glucose oxidase. In this assay, hydrogen peroxide released by glucose oxidation then oxidizes the dianisidine resulting in a color change proportional to glucose concentration. Absorbance of the glucose assays were read at 540 nm in a VERSAmax microplate reader (Molecular Devices). The background was subtracted with a no-cellulose control reaction and compared to that of glucose standards.

To assess hemicellulase activity, 100 μL of culture supernatant was incubated with 9 mg xylan in 900 μL of 100 mM sodium acetate, pH 5 for 30 minutes at 50° C. Released xylose was then measured by reduction of 3,5-dinitrosalicylic acid in a similar manner as the glucose oxidase assay.

Total protein was determined with the Bradford assay (BioRad).

Phylogenetic Analysis

Putative homologues to CLR-1 and CLR-2 were first identified through BLASTs to the NCBI protein database. The top hits from each BLAST were selected and were separately blasted to the *Neurospora crassa* protein database to verify CLR-1 or CLR-2 as the top hit and no other closely related *Neurospora* proteins. The phylogenetic trees were created using the maximum likelihood program PhyML with ALRT branch support. The CLR-2 tree has a loglk of −28588 and the CLR-1 tree has a loglk of −19403 (Anisimova M and Gascuel O, Systematic Biology, 55(4), 539-552 (2006)).

The phylogenetic trees were also run using Bayesian inference (MrBayes). (Huelsenbeck et al., (2001) Science 294: 2310-2314). One million generations were run with 8 chains, trees were sampled every 100 generations, with a burn-in of 2,500. The CLR-1 tree converged to 0.0056 and the CLR-2 tree converged to 0.0027. The resulting trees showed congruency with those generated with maximum likelihood (FIG. 9—phylogenetic trees based on Bayesian inference. They are identical to the maximum likelihood trees.)

RT-qPCR

```
Primers:
                                        (SEQ ID NO: 7)
    clr-1-F        5'-ATGACGCCGAACCGAGTG-3'

(SEQ ID NO: 8)
    clr-1-R        5'-CAACAACACCAGAATGCGG-3'

(SEQ ID NO: 9)
    clr-2-F        5'-TCCCGGCCATCAGACAGA-3'
```

```
                                (SEQ ID NO: 10)
clr-2-R    5'-ATCGGCACGGAAGGTTGTT-3'

(SEQ ID NO: 11)
B-actin-F  5'-TGATCTTACCGACTACCT-3'

(SEQ ID NO: 12)
B-actin-R  5'-CAGAGCTTCTCCTTGATG-3'

(SEQ ID NO: 13)
cbh1-F     5'-ATCTGGGAAGCGAACAAAG-3'

(SEQ ID NO: 14)
cbh1-R     5'-TAGCGGTCGTCGGAATAG-3'
```

Primer efficiencies were tested on a gDNA dilutions series to determine if they were comparable to each other. The 2489 wild type strain and the ccg-1::clr-1-GFP were grown on Vogels media with sucrose for 16 hours. The cultures were rinsed as described above and transferred to fresh media containing either Avicel® or sucrose as the carbon source. RNA was extracted four hours post transfer. RT qPCR was carried out using the One Step Green ER kit (Invitrogen). One nanogram of total RNA was used in each RT-qPCR reaction and amplification conditions used were as described in the manufacturer's manual. Three technical triplicates were run for each sample. For the analysis, reactions were averaged and normalized to B-actin expression using the delta-delta Ct method (Livak K J and Schmittgen T D, Methods, 25: 402 (2001)).

Tables

TABLE 1A

Genes under regulation by cellulose in wild type *N. crassa* clustered by level of induction/repression in clr mutants

| Gene | Annotation | Group 1 | Group 2 | Cluster |
|---|---|---|---|---|
| NCU00554 | aspartate-semialdehyde dehydrogenase | Amino Acid Metabolism | | No Induction |
| NCU00944 | l-allo-threonine aldolase | Amino Acid Metabolism | | No Induction |
| NCU01195 | Glu/Leu/Phe/Val dehydrogenase | Amino Acid Metabolism | | No Induction |
| NCU02785 | phospho-2-dehydro-3-deoxyheptonate aldolase | Amino Acid Metabolism | | No Induction |
| NCU02954 | homoisocitrate dehydrogenase | Amino Acid Metabolism | | No Induction |
| NCU03131 | FAD dependent oxidoreductase superfamily | Amino Acid Metabolism | | No Induction |
| NCU04216 | amidophosphoribosyltransferase | Amino Acid Metabolism | | No Induction |
| NCU04298 | pentafunctional AROM polypeptide | Amino Acid Metabolism | | No Induction |
| NCU04837 | mitochondrial 2-oxodicarboxylate carrier 1 | Amino Acid Metabolism | | No Induction |
| NCU05548 | phospho-2-dehydro-3-deoxyheptonate aldolase | Amino Acid Metabolism | | No Induction |
| NCU07413 | cytosine deaminase, variant | Amino Acid Metabolism | | No Induction |
| NCU10283 | tryptophan synthetase | Amino Acid Metabolism | | No Induction |
| NCU00461 | NAD-specific glutamate dehydrogenase | Amino Acid Metabolism | | No Repression |
| NCU00591 | methylcrotonoyl-CoA carboxylase subunit alpha | Amino Acid Metabolism | | No Repression |
| NCU00680 | 2-methylcitrate dehydratase | Amino Acid Metabolism | | No Repression |
| NCU01402 | indoleamine 2,3-dioxygenase | Amino Acid Metabolism | | No Repression |
| NCU02127 | methylcrotonoyl-CoA carboxylase subunit beta | Amino Acid Metabolism | | No Repression |
| NCU02704 | branched-chain alpha-keto acid dehydrogenase E2 | Amino Acid Metabolism | | No Repression |
| NCU02727 | glycine cleavage system T protein | Amino Acid Metabolism | | No Repression |
| NCU02936 | proline oxidase | Amino Acid Metabolism | | No Repression |
| NCU03076 | delta-1-pyrroline-5-carboxylate dehydrogenase | Amino Acid Metabolism | | No Repression |
| NCU03415 | aldehyde dehydrogenase | Amino Acid Metabolism | | No Repression |
| NCU03648 | glutaminase A | Amino Acid Metabolism | | No Repression |
| NCU03913 | 2-oxoisovalerate dehydrogenase beta subunit | Amino Acid Metabolism | | No Repression |
| NCU05499 | homogentisate 1,2-dioxygenase | Amino Acid Metabolism | | No Repression |
| NCU05537 | fumarylacetoacetase | Amino Acid Metabolism | | No Repression |
| NCU05977 | dihydrodipicolinate synthase | Amino Acid Metabolism | | No Repression |

TABLE 1A-continued

Genes under regulation by cellulose in wild type *N. crassa* clustered by level of induction/repression in clr mutants

| Gene | Annotation | Group 1 | Group 2 | Cluster |
|---|---|---|---|---|
| NCU06448 | enoyl-CoA hydratase | Amino Acid Metabolism | | No Repression |
| NCU06543 | acyl-CoA dehydrogenase | Amino Acid Metabolism | | No Repression |
| NCU07153 | glutamate carboxypeptidase | Amino Acid Metabolism | | No Repression |
| NCU08216 | cystathionine beta-synthase | Amino Acid Metabolism | | No Repression |
| NCU09116 | aromatic aminotransferase Aro8 | Amino Acid Metabolism | | No Repression |
| NCU09266 | methylmalonate-semialdehyde dehydrogenase | Amino Acid Metabolism | | No Repression |
| NCU09864 | 2-oxoisovalerate dehydrogenase alpha subunit | Amino Acid Metabolism | | No Repression |
| NCU11195 | D-isomer specific 2-hydroxyacid dehydrogenase | Amino Acid Metabolism | | No Repression |
| NCU01830 | 4-hydroxyphenylpyruvate dioxygenase | Amino Acid Metabolism | | No Repression |
| NCU02126 | isovaleryl-CoA dehydrogenase | Amino Acid Metabolism | | No Repression |
| NCU01744 | glutamate synthase | Amino Acid Metabolism | | Partial Induction |
| NCU03748 | saccharopine dehydrogenase | Amino Acid Metabolism | | Partial Induction |
| NCU06625 | cysteine dioxygenase | Amino Acid Metabolism | | Partial Repression |
| NCU04130 | acylase ACY 1 | Amino Acid Metabolism | | WT Induction |
| NCU10110 | 3-hydroxyisobutyrate dehydrogenase | Amino Acid Metabolism | | WT Induction |
| NCU03861 | glutaminase A | Amino Acid Metabolism | | WT Repression |
| NCU07623 | 2,2-dialkylglycine decarboxylase | Amino Acid Metabolism | | WT Repression |
| NCU01427 | geranylgeranyl pyrophosphate synthetase | Anabolism | Carotenoid Synthesis | WT Repression |
| NCU03651 | NADP-dependent malic enzyme | Anabolism | Fatty Acid Synthesis | No Induction |
| NCU02579 | FAS1 domain-containing protein | Anabolism | Fatty Acid Synthesis | No Repression |
| NCU07307 | fatty acid synthase beta subunit dehydratase | Anabolism | Fatty Acid Synthesis | Partial Repression |
| NCU07308 | fatty acid synthase alpha subunit reductase | Anabolism | Fatty Acid Synthesis | Partial Repression |
| NCU05858 | fatty acid oxygenase | Anabolism | Fatty Acid Synthesis | WT Repression |
| NCU01013 | delta-aminolevulinic acid dehydratase | Anabolism | Heme Anabolism | No Induction |
| NCU06189 | 5-aminolevulinate synthase | Anabolism | Heme Synthesis | No Induction |
| NCU05165 | pyridoxamine phosphate oxidase | Anabolism | Vitamin Metabolism | No Induction |
| NCU04865 | polyketide synthase 3 | Anabolism | | Partial Repression |
| NCU05011 | polyketide synthase 2 | Anabolism | | WT Induction |
| NCU00762 | endoglucanase 3 | Carbon Metabolism | Cellulases | No Induction |
| NCU00836 | hypothetical protein | Carbon Metabolism | Cellulases | No Induction |
| NCU01050 | endoglucanase II | Carbon Metabolism | Cellulases | No Induction |
| NCU02240 | endoglucanase II | Carbon Metabolism | Cellulases | No Induction |
| NCU02344 | fungal cellulose binding domain-containing | Carbon Metabolism | Cellulases | No Induction |
| NCU02916 | endoglucanase II | Carbon Metabolism | Cellulases | No Induction |
| NCU03328 | endoglucanase II | Carbon Metabolism | Cellulases | No Induction |
| NCU04854 | endoglucanase EG-1 | Carbon Metabolism | Cellulases | No Induction |

TABLE 1A-continued

Genes under regulation by cellulose in wild type *N. crassa* clustered by level of induction/repression in clr mutants

| Gene | Annotation | Group 1 | Group 2 | Cluster |
|---|---|---|---|---|
| NCU05057 | endoglucanase EG-1 | Carbon Metabolism | Cellulases | No Induction |
| NCU05121 | endoglucanase V | Carbon Metabolism | Cellulases | No Induction |
| NCU07190 | exoglucanase 3 | Carbon Metabolism | Cellulases | No Induction |
| NCU07340 | exoglucanase 1 | Carbon Metabolism | Cellulases | No Induction |
| NCU07760 | endoglucanase IV | Carbon Metabolism | Cellulases | No Induction |
| NCU07898 | endoglucanase IV | Carbon Metabolism | Cellulases | No Induction |
| NCU08760 | endoglucanase II | Carbon Metabolism | Cellulases | No Induction |
| NCU09680 | exoglucanase 2 | Carbon Metabolism | Cellulases | No Induction |
| NCU03322 | GDSL family lipase | Carbon Metabolism | Fatty Acid/Isoprenoid Metabolism | WT Induction |
| NCU07362 | L-lactate ferricytochrome c oxidoreductase | Carbon Metabolism | Fermentation | Partial Repression |
| NCU03813 | formate dehydrogenase | Carbon Metabolism | Fermentation | WT Induction |
| NCU04539 | L-lactate dehydrogenase | Carbon Metabolism | Fermentation | WT Repression |
| NCU08687 | galactokinase | Carbon Metabolism | Galactose Utilization | No Induction |
| NCU05133 | related to UDP-glucose 4-epimerase | Carbon Metabolism | Galactose Utilization | WT Induction |
| NCU09705 | GAL10 | Carbon Metabolism | Galactose Utilization | WT Induction |
| NCU07277 | anchored cell wall protein 8 | Carbon Metabolism | Glycogen/Starch Utilization | WT Induction |
| NCU04797 | fructose-1,6-bisphosphatase | Carbon Metabolism | Glycolysis | No Repression |
| NCU00575 | glucokinase | Carbon Metabolism | Glycolysis | Partial Induction |
| NCU04401 | fructose-bisphosphate aldolase | Carbon Metabolism | Glycolysis | WT Induction |
| NCU02855 | endo-1,4-beta-xylanase A | Carbon Metabolism | Hemicellulases | No Induction |
| NCU05924 | endo-1,4-beta-xylanase | Carbon Metabolism | Hemicellulases | No Induction |
| NCU05955 | Cel74a | Carbon Metabolism | Hemicellulases | No Induction |
| NCU07326 | hypothetical protein | Carbon Metabolism | Hemicellulases | No Induction |
| NCU09775 | alpha-N-arabinofuranosidase | Carbon Metabolism | Hemicellulases | No Induction |
| NCU04997 | xylanase | Carbon Metabolism | Hemicellulases | Partial Induction |
| NCU01900 | xylosidase/arabinosidase | Carbon Metabolism | Hemicellulases | WT Induction |
| NCU02343 | alpha-L-arabinofuranosidase 2 | Carbon Metabolism | Hemicellulases | WT Induction |
| NCU07225 | endo-1,4-beta-xylanase 2 | Carbon Metabolism | Hemicellulases | WT Induction |
| NCU08087 | hypothetical protein | Carbon Metabolism | Hemicellulases | WT Induction |
| NCU08189 | endo-1,4-beta-xylanase | Carbon Metabolism | Hemicellulases | WT Induction |
| NCU09652 | beta-xylosidase | Carbon Metabolism | Hemicellulases | WT Induction |
| NCU06881 | succinyl-CoA:3-ketoacid-coenzyme A transferase | Carbon Metabolism | Ketone Metabolism | No Repression |
| NCU01853 | choline dehydrogenase | Carbon Metabolism | Lipid/Isoprenoid Metabolism | No Repression |
| NCU02287 | acyl-CoA dehydrogenase | Carbon Metabolism | Lipid/Isoprenoid Metabolism | No Repression |
| NCU02894 | flavin-binding monooxygenase | Carbon Metabolism | Lipid/Isoprenoid Metabolism | No Repression |
| NCU07263 | carnitine/acyl carnitine carrier | Carbon Metabolism | Lipid/Isoprenoid Metabolism | No Repression |
| NCU08924 | acyl-CoA dehydrogenase | Carbon Metabolism | Lipid/Isoprenoid Metabolism | No Repression |

TABLE 1A-continued

Genes under regulation by cellulose in wild type *N. crassa* clustered by level of induction/repression in clr mutants

| Gene | Annotation | Group 1 | Group 2 | Cluster |
| --- | --- | --- | --- | --- |
| NCU09692 | phosphatidic acid phosphatase beta | Carbon Metabolism | Lipid/Isoprenoid Metabolism | No Repression |
| NCU04796 | 3-ketoacyl-CoA thiolase | Carbon Metabolism | Lipid/Isoprenoid Metabolism | No Repression |
| NCU09732 | acetyl-CoA acetyltransferase | Carbon Metabolism | Lipid/Isoprenoid Metabolism | No Repression |
| NCU07719 | isopentenyl-diphosphate delta-isomerase | Carbon Metabolism | Lipid/Isoprenoid Metabolism | Partial Repression |
| NCU12093 | N-acyl-phosphatidylethanolamine-hydrolyzing | Carbon Metabolism | Lipid/Isoprenoid Metabolism | Partial Repression |
| NCU05818 | phosphatidyl synthase | Carbon Metabolism | Lipid/Isoprenoid Metabolism | WT Repression |
| NCU04078 | NAD-dependent methanol dehydrogenase | Carbon Metabolism | Methanol Oxidation | No Repression |
| NCU07617 | Acr1 | Carbon Metabolism | Mitochondrial Carrier | WT Repression |
| NCU08398 | aldose 1-epimerase | Carbon Metabolism | Monnosaccharide Metabolism | No Induction |
| NCU10683 | NRS/ER | Carbon Metabolism | Monnosaccharide Metabolism | No Induction |
| NCU10063 | sugar isomerase | Carbon Metabolism | Monnosaccharide Metabolism | Partial Repression |
| NCU04933 | nucleoside-diphosphate-sugar epimerase | Carbon Metabolism | Monnosaccharide Metabolism | WT Induction |
| NCU00890 | beta-mannosidase | Carbon Metabolism | Oligosaccharide Degredation | No Induction |
| NCU04623 | beta-galactosidase | Carbon Metabolism | Oligosaccharide Degredation | No Induction |
| NCU04952 | beta-D-glucoside glucohydrolase | Carbon Metabolism | Oligosaccharide Degredation | No Induction |
| NCU05956 | beta-galactosidase | Carbon Metabolism | Oligosaccharide Degredation | No Induction |
| NCU07487 | periplasmic beta-glucosidase | Carbon Metabolism | Oligosaccharide Degredation | No Induction |
| NCU08755 | beta-glucosidase 1 | Carbon Metabolism | Oligosaccharide Degredation | No Induction |
| NCU00130 | beta-glucosidase | Carbon Metabolism | Oligosaccharide Degredation | Partial Induction |
| NCU00709 | beta-xylosidase | Carbon Metabolism | Oligosaccharide Degredation | WT Induction |
| NCU04168 | hypothetical protein | Carbon Metabolism | Oligosaccharide Degredation | WT Induction |
| NCU09904 | glucan 1,3-beta-glucosidase | Carbon Metabolism | Oligosaccharide Degredation | WT Induction |
| NCU09923 | beta-xylosidase | Carbon Metabolism | Oligosaccharide Degredation | WT Induction |
| NCU03098 | glycosyl hydrolase | Carbon Metabolism | Oligosaccharide Degredation | WT Repression |
| NCU09028 | class I alpha-mannosidase | Carbon Metabolism | Oligosaccharide Degredation | WT Repression |
| NCU09281 | alpha-glucosidase | Carbon Metabolism | Oligosaccharide Degredation | WT Repression |
| NCU10107 | ribose 5-phosphate isomerase | Carbon Metabolism | Pentose Phosphate Pathway | WT Induction |
| NCU00206 | cellobiose dehydrogenase | Carbon Metabolism | Polysaccharide Degradation | No Induction |
| NCU00710 | acetyl xylan esterase | Carbon Metabolism | Polysaccharide Degradation | No Induction |
| NCU01059 | glycosyl hydrolase family 47 protein | Carbon Metabolism | Polysaccharide Degradation | No Induction |
| NCU03181 | acetylxylan esterase | Carbon Metabolism | Polysaccharide Degradation | No Induction |
| NCU04494 | acetyl xylan esterase | Carbon Metabolism | Polysaccharide Degradation | No Induction |
| NCU05598 | rhamnogalacturonase B | Carbon Metabolism | Polysaccharide Degradation | No Induction |
| NCU05751 | cellulose-binding protein | Carbon Metabolism | Polysaccharide Degradation | No Induction |
| NCU08176 | pectate lyase A | Carbon Metabolism | Polysaccharide Degradation | No Induction |
| NCU08746 | starch binding domain-containing protein | Carbon Metabolism | Polysaccharide Degradation | No Induction |
| NCU08785 | fungal cellulose binding domain-containing | Carbon Metabolism | Polysaccharide Degradation | No Induction |

TABLE 1A-continued

Genes under regulation by cellulose in wild type *N. crassa* clustered by level of induction/repression in clr mutants

| Gene | Annotation | Group 1 | Group 2 | Cluster |
|---|---|---|---|---|
| NCU09445 | Cip2 | Carbon Metabolism | Polysaccharide Degradation | No Induction |
| NCU09491 | feruloyl esterase B | Carbon Metabolism | Polysaccharide Degradation | No Induction |
| NCU09582 | chitin deacetylase | Carbon Metabolism | Polysaccharide Degradation | No Induction |
| NCU09764 | hypothetical protein | Carbon Metabolism | Polysaccharide Degradation | No Induction |
| NCU09774 | cellulase | Carbon Metabolism | Polysaccharide Degradation | No Induction |
| NCU09976 | rhamnogalacturonan acetylesterase | Carbon Metabolism | Polysaccharide Degradation | No Induction |
| NCU10045 | pectinesterase | Carbon Metabolism | Polysaccharide Degradation | No Induction |
| NCU11068 | endo-beta-1,4-mannanase | Carbon Metabolism | Polysaccharide Degradation | No Induction |
| NCU11198 | arabinogalactan endo-1,4-beta-galactosidase | Carbon Metabolism | Polysaccharide Degradation | No Induction |
| NCU02904 | alpha/beta hydrolase fold protein | Carbon Metabolism | Polysaccharide Degradation | Partial Induction |
| NCU04870 | acetyl xylan esterase | Carbon Metabolism | Polysaccharide Degradation | Partial Induction |
| NCU05159 | acetylxylan esterase | Carbon Metabolism | Polysaccharide Degradation | Partial Induction |
| NCU09518 | glucooligosaccharide oxidase | Carbon Metabolism | Polysaccharide Degradation | Partial Induction |
| NCU09664 | acetylxylan esterase | Carbon Metabolism | Polysaccharide Degradation | Partial Induction |
| NCU09924 | BNR/Asp-box repeat protein | Carbon Metabolism | Polysaccharide Degradation | Partial Induction |
| NCU03158 | alpha/beta hydrolase | Carbon Metabolism | Polysaccharide Degradation | Partial Repression |
| NCU07067 | mannosyl-oligosaccharide alpha-1,2-mannosidase | Carbon Metabolism | Polysaccharide Degradation | Partial Repression |
| NCU01353 | mixed-linked glucanase | Carbon Metabolism | Polysaccharide Degradation | WT Induction |
| NCU07269 | alpha-1,2-mannosidase | Carbon Metabolism | Polysaccharide Degradation | WT Repression |
| NCU06023 | catabolic 3-dehydroquinase | Carbon Metabolism | Quinnic Acid Utilization | Partial Repression |
| NCU06025 | shikimate/quinate 5-dehydrogenase | Carbon Metabolism | Quinnic Acid Utilization | WT Repression |
| NCU00761 | triacylglycerol lipase | Carbon Metabolism | Secreted Lipases/Esterases | No Induction |
| NCU06650 | secretory phospholipase A2 | Carbon Metabolism | Secreted Lipases/Esterases | No Induction |
| NCU09416 | cellulose-binding GDSL lipase/acylhydrolase | Carbon Metabolism | Secreted Lipases/Esterases | Partial Induction |
| NCU00292 | cholinesterase | Carbon Metabolism | Secreted Lipases/Esterases | WT Induction |
| NCU03903 | lipase/esterase | Carbon Metabolism | Secreted Lipases/Esterases | WT Induction |
| NCU04475 | lipase B | Carbon Metabolism | Secreted Lipases/Esterases | WT Induction |
| NCU06364 | GDSL lipase/acylhydrolase | Carbon Metabolism | Secreted Lipases/Esterases | WT Induction |
| NCU09575 | sterol esterase | Carbon Metabolism | Secreted Lipases/Esterases | WT Repression |
| NCU04230 | isocitrate lyase | Carbon Metabolism | TCA | No Repression |
| NCU02366 | aconitase | Carbon Metabolism | TCA | WT Repression |
| NCU04280 | aconitate hydratase | Carbon Metabolism | TCA | WT Repression |
| NCU04385 | 3-isopropylmalate dehydratase | Carbon Metabolism | TCA | WT Repression |
| NCU02969 | alkaline ceramidase | Carbon Metabolism | Transcription Factors | WT Repression |
| NCU08164 | retinol dehydrogenase 13 | Carbon Metabolism | Vitamin Metabolism | Partial Induction |
| NCU00891 | xylitol dehydrogenase | Carbon Metabolism | Xylose Utilization | WT Induction |
| NCU08384 | xylose reductase | Carbon Metabolism | Xylose Utilization | WT Induction |

TABLE 1A-continued

Genes under regulation by cellulose in wild type *N. crassa* clustered by level of induction/repression in clr mutants

| Gene | Annotation | Group 1 | Group 2 | Cluster |
|---|---|---|---|---|
| NCU08272 | cytochrome b2 | Carbon Metabolism | | No Repression |
| NCU07619 | FAD binding domain-containing protein | Carbon Metabolism | | Partial Repression |
| NCU05304 | nuclear segregation protein | Cell Cycle | | No Induction |
| NCU01510 | meiotically up-regulated 190 protein | Cell Cycle | | No Repression |
| NCU05768 | mating response protein POI2 | Cell Cycle | | Partial Repression |
| NCU07154 | yippee family protein | Cell Cycle | | Partial Repression |
| NCU01998 | septin | Cell Cycle | | WT Induction |
| NCU08457 | rodlet protein | Cellular Components | Ascospore | WT Repression |
| NCU06386 | dolichyl-phosphate beta-glucosyltransferase | Cellular Components | Cell Wall Synthesis or Modifcation | No Induction |
| NCU09425 | NdvB protein | Cellular Components | Cell Wall Synthesis or Modifcation | Partial Induction |
| NCU02478 | alpha-1,3-glucan synthase Ags2 | Cellular Components | Cell Wall Synthesis or Modifcation | WT Induction |
| NCU09175 | GPI-anchored cell wall beta-1,3-endoglucanase | Cellular Components | Cell Wall Synthesis or Modifcation | WT Induction |
| NCU01689 | mitochondrial DNA replication protein YHM2 | Cellular Components | Mitochondrial Reproduction | No Induction |
| NCU11721 | mitochondrial inner membrane protease subunit 2 | Cellular Components | Mitochondrial Reproduction | No Induction |
| NCU02396 | mitochondrial FAD-linked sulfhydryl oxidase | Cellular Components | Mitochondrial Reproduction | No Repression |
| NCU07481 | morphogenesis protein | Cellular Components | Morphology | WT Induction |
| NCU03137 | nuclear elongation and deformation protein 1 | Classification Unclear | | No Induction |
| NCU02500 | clock-controlled pheromone CCG-4 | Clock Controlled | | No Induction |
| NCU00565 | lipoic acid synthetase | Cofactors | | No Repression |
| NCU02705 | F1F0 ATP synthase assembly protein Atp10 | Electron transport chain | | No Repression |
| NCU05225 | mitochondrial NADH dehydrogenase | Electron transport chain | | Partial Repression |
| NCU08326 | mitochondrial carrier protein LEU5 | Fermentation | | No Repression |
| NCU00326 | calcium homeostasis protein Regucalcin | Ion Binding | | No Induction |
| NCU08691 | EF-hand calcium-binding domain-containing | Ion Binding | | WT Repression |
| NCU09043 | caleosin domain-containing protein | Lipid Associated | | Partial Repression |
| NCU07432 | tetraspanin | Membrane Associated | | Partial Induction |
| NCU05841 | UMTA | Methyl transferase | | Partial Induction |
| NCU02361 | formamidase | Nitrogen and Sulfur Metabolism | | No Repression |
| NCU10051 | flavohemoglobin | Nitrogen Metabolism | | Partial Induction |
| NCU04720 | nitrite reductase | Nitrogen Metabolism | | WT Induction |
| NCU04698 | spermine/spermidine synthase | Nucleotide Binding | | Partial Induction |
| NCU00177 | phosphoribosylformylglycinamidine cyclo-ligase | Nucleotide Metabolism | | No Induction |
| NCU01786 | ribose-phosphate pyrophosphokinase II | Nucleotide Metabolism | | No Induction |
| NCU03117 | inosine-5'-monophosphate dehydrogenase IMD2 | Nucleotide Metabolism | | No Induction |
| NCU05254 | ribose-phosphate pyrophosphokinase | Nucleotide Metabolism | | No Induction |

TABLE 1A-continued

Genes under regulation by cellulose in wild type *N. crassa* clustered by level of induction/repression in clr mutants

| Gene | Annotation | Group 1 | Group 2 | Cluster |
|---|---|---|---|---|
| NCU03963 | 5'-methylthioadenosine phosphorylase | Nucleotide Metabolism | | No Induction |
| NCU09659 | 5'-nucleotidase | Nucleotide Metabolism | | No Repression |
| NCU03488 | orotidine-5'-phosphate decarboxylase Pyr-4 | Nucleotide Metabolism | | Partial Repression |
| NCU02657 | s-adenosylmethionine synthetase | Other | | No Induction |
| NCU05855 | O-methyltransferase | Other | | No Induction |
| NCU08044 | oxidoreductase | Other | | No Induction |
| NCU09283 | acetyltransferase | Other | | No Induction |
| NCU11243 | alcohol dehydrogenase | Other | | No Induction |
| NCU01378 | acetoacetyl-CoA synthase | Other | | No Repression |
| NCU01861 | short chain dehydrogenase/reductase family | Other | | No Repression |
| NCU04583 | acetyltransferase | Other | | No Repression |
| NCU06616 | S-adenosylmethionine-dependent | Other | | No Repression |
| NCU07325 | conidiation-specific protein con-10 | Other | | No Repression |
| NCU08771 | acetolactate synthase | Other | | No Repression |
| NCU09553 | 3-hydroxybutyryl CoA dehydrogenase | Other | | No Repression |
| NCU10055 | opsin-1 | Other | | No Repression |
| NCU11289 | aldo-keto reductase | Other | | No Repression |
| NCU08750 | isoamyl alcohol oxidase | Other | | Partial Induction |
| NCU08752 | acetylcholinesterase | Other | | Partial Induction |
| NCU03049 | flavin-binding monooxygenase | Other | | Partial Repression |
| NCU05653 | carbonic anhydrase | Other | | Partial Repression |
| NCU07133 | metallo-beta-lactamase superfamily protein | Other | | Partial Repression |
| NCU08925 | amine oxidase | Other | | Partial Repression |
| NCU09865 | methylase | Other | | Partial Repression |
| NCU11365 | aminotransferase | Other | | Partial Repression |
| NCU07055 | monooxygenase | Other | | WT Induction |
| NCU07224 | monooxygenase | Other | | WT Induction |
| NCU01061 | dienelactone hydrolase | Other | | WT Repression |
| NCU03566 | short chain dehydrogenase/reductase | Other | | WT Repression |
| NCU04260 | oxidoreductase domain-containing protein | Other | | WT Repression |
| NCU05094 | short chain dehydrogenase/reductase | Other | | WT Repression |
| NCU05986 | sucrase/ferredoxin domain-containing protein | Other | | WT Repression |
| NCU06153 | monooxygenase | Other | | WT Repression |
| NCU09674 | O-methyltransferase family 3 | Other | | WT Repression |
| NCU11241 | nuclease domain-containing protein | Other | | WT Repression |
| NCU03013 | anchored cell wall protein 10 | Oxidoreductase | Superoxide dismutase | WT Induction |
| NCU05319 | LysM domain-containing protein | Peptidoglycan Binding | | Partial Induction |

TABLE 1A-continued

Genes under regulation by cellulose in wild type *N. crassa* clustered by level of induction/repression in clr mutants

| Gene | Annotation | Group 1 | Group 2 | Cluster |
|---|---|---|---|---|
| NCU04430 | leupeptin-inactivating enzyme 1 | Protease | Protease Activator | WT Induction |
| NCU02059 | endothiapepsin | Protease | | No Induction |
| NCU00831 | extracellular serine carboxypeptidase | Protease | | No Repression |
| NCU06055 | extracellular alkaline protease | Protease | | Partial Induction |
| NCU00263 | serin endopeptidase | Protease | | WT Induction |
| NCU07200 | metalloprotease 1 | Protease | | WT Induction |
| NCU09992 | serine peptidase | Protease | | WT Induction |
| NCU09265 | calreticulin | Protein Synthesis and Secretion | Protein Folding | No Induction |
| NCU00813 | disulfide isomerase | Protein Synthesis and Secretion | Protein Folding | No Induction |
| NCU02455 | FKBP-type peptidyl-prolyl cis-trans isomerase | Protein Synthesis and Secretion | Protein Folding | No Induction |
| NCU09223 | protein disulfide-isomerase | Protein Synthesis and Secretion | Protein Folding | No Induction |
| NCU09485 | related to stress protein ORP150 | Protein Synthesis and Secretion | Protein Folding | No Induction |
| NCU01648 | dolichyl-phosphate-mannose-protein | Protein Synthesis and Secretion | Protein Modification | No Induction |
| NCU10497 | oligosaccharyl transferase STT3 subunit | Protein Synthesis and Secretion | Protein Modification | No Induction |
| NCU00669 | oligosaccharyl transferase subunit | Protein Synthesis and Secretion | Protein Modification | No Induction |
| NCU02118 | palmitoyltransferase PFA4 | Protein Synthesis and Secretion | Protein Modification | No Repression |
| NCU10762 | UDP-N-acetyl-glucosamine-1-P transferase Alg7 | Protein Synthesis and Secretion | Protein Modification | Partial Induction |
| NCU00244 | glycosyl transferase | Protein Synthesis and Secretion | Protein Modification | WT Repression |
| NCU01068 | BAR domain-containing protein | Protein Synthesis and Secretion | Protein Trafficing | No Induction |
| NCU03319 | COPII-coated vesicle protein SurF4/Erv29 | Protein Synthesis and Secretion | Protein Trafficing | No Induction |
| NCU08761 | vacuolar sorting receptor | Protein Synthesis and Secretion | Protein Trafficing | No Induction |
| NCU01279 | ER membrane protein | Protein Synthesis and Secretion | Protein Trafficing | No Repression |
| NCU03819 | COPII coat assembly protein sec-16 | Protein Synthesis and Secretion | Protein Trafficing | Partial Induction |
| NCU08607 | endoplasmic reticulum-Golgi intermediate | Protein Synthesis and Secretion | Protein Trafficing | Partial Induction |
| NCU09195 | vacuolar membrane PQ loop repeat protein | Protein Synthesis and Secretion | Protein Trafficing | Partial Repression |
| NCU07736 | PEP5 | Protein Synthesis and Secretion | Protein Trafficing | WT Induction |
| NCU01290 | centromere/microtubule-binding protein CBF5 | Protein Synthesis and Secretion | rRNA Production | No Induction |
| NCU03396 | nucleolar protein nop-58 | Protein Synthesis and Secretion | rRNA Production | No Induction |
| NCU09521 | ribosome biogenesis protein | Protein Synthesis and Secretion | rRNA Production | No Induction |
| NCU03897 | RNA binding effector protein Scp160 | Protein Synthesis and Secretion | Translation | No Induction |
| NCU07746 | F-box domain-containing protein | Protein Synthesis and Secretion | Translocation | No Induction |
| NCU08897 | protein transporter SEC61 subunit alpha | Protein Synthesis and Secretion | Translocation | No Induction |
| NCU00169 | translocation complex componenet | Protein Synthesis and Secretion | Translocation | No Induction |
| NCU02681 | translocation protein | Protein Synthesis and Secretion | Translocation | No Induction |
| NCU06333 | translocation protein SEC62 | Protein Synthesis and Secretion | Translocation | No Induction |
| NCU01146 | signal sequence receptor alpha chain | Protein Synthesis and Secretion | Translocation | Partial Induction |
| NCU00931 | lysyl-tRNA synthetase | Protein Synthesis and Secretion | tRNA Charging | No Induction |

TABLE 1A-continued

Genes under regulation by cellulose in wild type *N. crassa* clustered by level of induction/repression in clr mutants

| Gene | Annotation | Group 1 | Group 2 | Cluster |
|---|---|---|---|---|
| NCU07008 | carotenoid oxygenase 1 | Secondary Metabolism | Carotenoid Synthesis | WT Repression |
| NCU03295 | 4-coumarate-CoA ligase 1 | Secondary Metabolism | | No Repression |
| NCU07737 | salicylate hydroxylase | Secondary Metabolism | | WT Induction |
| NCU08038 | CAS1 | Signal Transduction | Adenlyate Cyclase Control | Partial Induction |
| NCU02729 | transducin family protein | Signal Transduction | | No Induction |
| NCU03364 | DENN domain-containing protein | Signal Transduction | | No Induction |
| NCU03817 | FMI1 protein | Signal Transduction | | Partial Repression |
| NCU06111 | GTPase Ras2p | Signal Transduction | | WT Repression |
| NCU08115 | DNA mismatch repair protein Msh3 | Stress Response | | Partial Induction |
| NCU06931 | sulfite oxidase | Sulfur Metabolism | | No Repression |
| NCU04077 | assimilatory sulfite reductase | Sulfur Metabolism | | Partial Induction |
| NCU01862 | SWIRM domain-containing protein FUN19 | Transcriptional Regulation | Chromatin Remodeling | No Repression |
| NCU02795 | histone deacetylase phd1 | Transcriptional Regulation | Chromatin Remodeling | WT Induction |
| NCU00812 | exosome complex exonuclease RRP41 | Transcriptional Regulation | RNA processing | No Induction |
| NCU01856 | transcriptional activator hac1 | Transcriptional Regulation | Transcription Factors | No Induction |
| NCU03725 | VIB-1 | Transcriptional Regulation | Transcription Factors | No Induction |
| NCU06971 | transcriptional activator xlnR | Transcriptional Regulation | Transcription Factors | No Induction |
| NCU07705 | C6 finger domain-containing protein | Transcriptional Regulation | Transcription Factors | No Induction |
| NCU08042 | fungal specific transcription factor | Transcriptional Regulation | Transcription Factors | No Induction |
| NCU03643 | cutinase transcription factor 1 beta | Transcriptional Regulation | Transcription Factors | No Repression |
| NCU03043 | C2H2 finger domain-containing protein FlbC | Transcriptional Regulation | Transcription Factors | Partial Repression |
| NCU05767 | PRO1A C6 Zink-finger protein | Transcriptional Regulation | Transcription Factors | WT Repression |
| NCU00316 | peroxisomal adenine nucleotide transporter 1 | Transporter | Amino Acid Transporter | No Repression |
| NCU00721 | proline-specific permease | Transporter | Amino Acid Transporter | No Repression |
| NCU07578 | peroxisomal adenine nucleotide transporter 1 | Transporter | Amino Acid Transporter | No Repression |
| NCU04435 | general amino acid permease AGP3 | Transporter | Amino Acid Transporter | Partial Repression |
| NCU05198 | general amino acid permease | Transporter | Amino Acid Transporter | Partial Repression |
| NCU10721 | solute carrier family 35 member B1 protein | Transporter | Carbohydrate Transport | No Induction |
| NCU11342 | MFS hexose transporter | Transporter | Carbohydrate Transport | No Induction |
| NCU00821 | sugar transporter | Transporter | Carbohydrate Transport | No Repression |
| NCU08561 | succinate/fumarate mitochondrial transporter | Transporter | Carbohydrate Transport | No Repression |
| NCU09287 | sugar transporter | Transporter | Carbohydrate Transport | No Repression |
| NCU00801 | MFS lactose permease | Transporter | Carbohydrate Transport | Partial Induction |
| NCU00809 | MFS monosaccharide transporter | Transporter | Carbohydrate Transport | Partial Induction |
| NCU07668 | MFS multidrug transporter | Transporter | Carbohydrate Transport | Partial Induction |
| NCU05089 | MFS monocarboxylate transporter | Transporter | Carbohydrate Transport | Partial Repression |
| NCU08152 | high affinity glucose transporter | Transporter | Carbohydrate Transport | Partial Repression |

TABLE 1A-continued

Genes under regulation by cellulose in wild type *N. crassa*
clustered by level of induction/repression in clr mutants

| Gene | Annotation | Group 1 | Group 2 | Cluster |
|---|---|---|---|---|
| NCU01633 | hexose transporter HXT13 | Transporter | Carbohydrate Transport | WT Induction |
| NCU04537 | monosaccharide transporter | Transporter | Carbohydrate Transport | WT Induction |
| NCU05853 | MFS sugar transporter | Transporter | Carbohydrate Transport | WT Induction |
| NCU08114 | hexose transporter | Transporter | Carbohydrate Transport | WT Induction |
| NCU00023 | ferric reductase | Transporter | Ion Transporter | No Induction |
| NCU02009 | FreB | Transporter | Ion Transporter | No Induction |
| NCU07068 | K(+)/H(+) antiporter 1 | Transporter | Ion Transporter | No Repression |
| NCU03305 | calcium-transporting ATPase | Transporter | Ion Transporter | Partial Induction |
| NCU08225 | high affinity nickel transporter nic1 | Transporter | Ion Transporter | Partial Repression |
| NCU08147 | Na or K P-type ATPase | Transporter | Ion Transporter | Partial Repression |
| NCU06366 | Ca2+/H+ antiporter | Transporter | Ion Transporter | WT Repression |
| NCU05585 | MFS quinate transporter | Transporter | Quinate | Partial Repression |
| NCU06138 | quinate permease | Transporter | Quinate | WT Induction |
| NCU05591 | ABC transporter CDR4 | Transporter | Trehalose Export | WT Induction |
| NCU06032 | long-chain fatty acid transporter | Transporter | | No Induction |
| NCU09098 | tetracycline transporter | Transporter | | No Induction |
| NCU10009 | ATP-binding cassette transporter | Transporter | | No Induction |
| NCU00290 | ABC transporter | Transporter | | No Repression |
| NCU09580 | MSF membrane transporter | Transporter | | No Repression |
| NCU00803 | MFS transporter, variant | Transporter | | Partial Repression |
| NCU04374 | MFS transporter | Transporter | | Partial Repression |
| NCU08425 | major facilitator superfamily transporter MFS_1 | Transporter | | Partial Repression |
| NCU04097 | ABC transporter | Transporter | | WT Induction |
| NCU05079 | MFS peptide transporter | Transporter | | WT Induction |
| NCU07546 | multidrug resistance protein MDR | Transporter | | WT Induction |
| NCU08148 | H+/nucleoside cotransporter | Transporter | | WT Induction |
| NCU03107 | MFS transporter | Transporter | | WT Repression |
| NCU00586 | non-anchored cell wall protein 6 | Unknown Cell Wall | | No Repression |
| NCU00716 | non-anchored cell wall protein 5 | Unknown Cell Wall | | No Repression |
| NCU00025 | integral membrane protein | Unknown Membrane Proteins | | Partial Repression |
| NCU00848 | integral membrane protein TmpA | Unknown Membrane Proteins | | WT Repression |
| NCU00449 | hypothetical protein | Unknown Secreted | | No Induction |
| NCU00849 | hypothetical protein | Unknown Secreted | | No Induction |
| NCU01058 | hypothetical protein | Unknown Secreted | | No Induction |
| NCU01076 | hypothetical protein | Unknown Secreted | | No Induction |
| NCU01196 | hypothetical protein | Unknown Secreted | | No Induction |

TABLE 1A-continued

Genes under regulation by cellulose in wild type *N. crassa*
clustered by level of induction/repression in clr mutants

| Gene | Annotation | Group 1 | Group 2 | Cluster |
|---|---|---|---|---|
| NCU01978 | hypothetical protein | Unknown | | No |
| | | Secreted | | Induction |
| NCU02138 | hypothetical protein | Unknown | | No |
| | | Secreted | | Induction |
| NCU03083 | hypothetical protein | Unknown | | No |
| | | Secreted | | Induction |
| NCU03982 | glucose-regulated protein | Unknown | | No |
| | | Secreted | | Induction |
| NCU04948 | hypothetical protein | Unknown | | No |
| | | Secreted | | Induction |
| NCU05230 | hypothetical protein | Unknown | | No |
| | | Secreted | | Induction |
| NCU05863 | hypothetical protein | Unknown | | No |
| | | Secreted | | Induction |
| NCU05864 | hypothetical protein | Unknown | | No |
| | | Secreted | | Induction |
| NCU06152 | hypothetical protein | Unknown | | No |
| | | Secreted | | Induction |
| NCU06607 | hypothetical protein | Unknown | | No |
| | | Secreted | | Induction |
| NCU08756 | hypothetical protein | Unknown | | No |
| | | Secreted | | Induction |
| NCU08790 | hypothetical protein | Unknown | | No |
| | | Secreted | | Induction |
| NCU09295 | hypothetical protein | Unknown | | No |
| | | Secreted | | Induction |
| NCU09524 | hypothetical protein | Unknown | | No |
| | | Secreted | | Induction |
| NCU11268 | hypothetical protein | Unknown | | No |
| | | Secreted | | Induction |
| NCU11542 | hypothetical protein | Unknown | | No |
| | | Secreted | | Induction |
| NCU11753 | hypothetical protein | Unknown | | No |
| | | Secreted | | Induction |
| NCU00175 | hypothetical protein | Unknown | | No |
| | | Secreted | | Repression |
| NCU00250 | hypothetical protein | Unknown | | No |
| | | Secreted | | Repression |
| NCU00322 | hypothetical protein | Unknown | | No |
| | | Secreted | | Repression |
| NCU00695 | hypothetical protein | Unknown | | No |
| | | Secreted | | Repression |
| NCU07311 | hypothetical protein | Unknown | | No |
| | | Secreted | | Repression |
| NCU08171 | anchored cell wall protein 12 | Unknown | | No |
| | | Secreted | | Repression |
| NCU08521 | hypothetical protein | Unknown | | No |
| | | Secreted | | Repression |
| NCU10507 | hypothetical protein | Unknown | | No |
| | | Secreted | | Repression |
| NCU07143 | 6-phosphogluconolactonase | Unknown | | Partial |
| | | Secreted | | Induction |
| NCU07222 | hypothetical protein | Unknown | | Partial |
| | | Secreted | | Induction |
| NCU08371 | hypothetical protein | Unknown | | Partial |
| | | Secreted | | Induction |
| NCU09506 | hypothetical protein | Unknown | | Partial |
| | | Secreted | | Induction |
| NCU04106 | hypothetical protein | Unknown | | Partial |
| | | Secreted | | Repression |
| NCU06526 | hypothetical protein | Unknown | | Partial |
| | | Secreted | | Repression |
| NCU09196 | hypothetical protein | Unknown | | Partial |
| | | Secreted | | Repression |
| NCU11466 | hypothetical protein | Unknown | | Partial |
| | | Secreted | | Repression |
| NCU11957 | hypothetical protein | Unknown | | Partial |
| | | Secreted | | Repression |
| NCU00995 | hypothetical protein | Unknown | | WT |
| | | Secreted | | Induction |
| NCU01720 | hypothetical protein | Unknown | | WT |
| | | Secreted | | Induction |
| NCU03293 | hypothetical protein | Unknown | | WT |
| | | Secreted | | Induction |

TABLE 1A-continued

Genes under regulation by cellulose in wild type *N. crassa* clustered by level of induction/repression in clr mutants

| Gene | Annotation | Group 1 | Group 2 | Cluster |
|---|---|---|---|---|
| NCU04169 | hypothetical protein | Unknown Secreted | | WT Induction |
| NCU04170 | hypothetical protein | Unknown Secreted | | WT Induction |
| NCU04467 | hypothetical protein | Unknown Secreted | | WT Induction |
| NCU04932 | hypothetical protein | Unknown Secreted | | WT Induction |
| NCU04998 | hypothetical protein | Unknown Secreted | | WT Induction |
| NCU05134 | hypothetical protein | Unknown Secreted | | WT Induction |
| NCU05350 | hypothetical protein | Unknown Secreted | | WT Induction |
| NCU05829 | hypothetical protein | Unknown Secreted | | WT Induction |
| NCU05852 | glucuronan lyase A | Unknown Secreted | | WT Induction |
| NCU05908 | hypothetical protein | Unknown Secreted | | WT Induction |
| NCU06143 | hypothetical protein | Unknown Secreted | | WT Induction |
| NCU06983 | hypothetical protein | Unknown Secreted | | WT Induction |
| NCU06991 | hypothetical protein | Unknown Secreted | | WT Induction |
| NCU08635 | hypothetical protein | Unknown Secreted | | WT Induction |
| NCU09046 | hypothetical protein | Unknown Secreted | | WT Induction |
| NCU09172 | hypothetical protein | Unknown Secreted | | WT Induction |
| NCU09424 | hypothetical protein | Unknown Secreted | | WT Induction |
| NCU09498 | hypothetical protein | Unknown Secreted | | WT Induction |
| NCU09823 | hypothetical protein | Unknown Secreted | | WT Induction |
| NCU09848 | hypothetical protein | Unknown Secreted | | WT Induction |
| NCU10014 | hypothetical protein | Unknown Secreted | | WT Induction |
| NCU10039 | hypothetical protein | Unknown Secreted | | WT Induction |
| NCU10687 | hypothetical protein | Unknown Secreted | | WT Induction |
| NCU00561 | hypothetical protein | Unknown Secreted | | WT Repression |
| NCU00859 | hypothetical protein | Unknown Secreted | | WT Repression |
| NCU02042 | hypothetical protein | Unknown Secreted | | WT Repression |
| NCU02164 | hypothetical protein | Unknown Secreted | | WT Repression |
| NCU04482 | hypothetical protein | Unknown Secreted | | WT Repression |
| NCU04486 | hypothetical protein | Unknown Secreted | | WT Repression |
| NCU05236 | hypothetical protein | Unknown Secreted | | WT Repression |
| NCU05761 | hypothetical protein | Unknown Secreted | | WT Repression |
| NCU05763 | hypothetical protein | Unknown Secreted | | WT Repression |
| NCU06328 | hypothetical protein | Unknown Secreted | | WT Repression |
| NCU07948 | hypothetical protein | Unknown Secreted | | WT Repression |
| NCU08140 | hypothetical protein | Unknown Secreted | | WT Repression |
| NCU08447 | hypothetical protein | Unknown Secreted | | WT Repression |

TABLE 1A-continued

Genes under regulation by cellulose in wild type *N. crassa* clustered by level of induction/repression in clr mutants

| Gene | Annotation | Group 1 | Group 2 | Cluster |
|---|---|---|---|---|
| NCU09734 | hypothetical protein | Unknown Secreted | | WT Repression |
| NCU12011 | hypothetical protein | Unknown Secreted | | WT Repression |
| NCU00408 | hypothetical protein | | | No Induction |
| NCU00633 | hypothetical protein | | | No Induction |
| NCU00870 | hypothetical protein | | | No Induction |
| NCU00871 | hypothetical protein | | | No Induction |
| NCU00965 | hypothetical protein | | | No Induction |
| NCU01003 | hypothetical protein | | | No Induction |
| NCU01049 | hypothetical protein | | | No Induction |
| NCU01077 | hypothetical protein | | | No Induction |
| NCU01148 | methyltransferase | | | No Induction |
| NCU01944 | hypothetical protein | | | No Induction |
| NCU01970 | DUF718 domain-containing protein | | | No Induction |
| NCU01983 | hypothetical protein | | | No Induction |
| NCU02008 | hypothetical protein | | | No Induction |
| NCU02061 | hypothetical protein | | | No Induction |
| NCU02600 | DUF1479 domain-containing protein | | | No Induction |
| NCU02625 | hypothetical protein | | | No Induction |
| NCU02720 | hypothetical protein | | | No Induction |
| NCU02915 | hypothetical protein | | | No Induction |
| NCU03152 | DUF1348 domain-containing protein | | | No Induction |
| NCU03329 | hypothetical protein | | | No Induction |
| NCU03433 | hypothetical protein | | | No Induction |
| NCU04127 | hypothetical protein | | | No Induction |
| NCU04522 | hypothetical protein | | | No Induction |
| NCU04830 | hypothetical protein | | | No Induction |
| NCU04905 | hypothetical protein | | | No Induction |
| NCU05056 | hypothetical protein | | | No Induction |
| NCU05170 | hypothetical protein | | | No Induction |
| NCU05569 | hypothetical protein | | | No Induction |
| NCU05574 | hypothetical protein, variant | | | No Induction |
| NCU05846 | hypothetical protein | | | No Induction |
| NCU05848 | cytochrome P450 monooxygenase | | | No Induction |
| NCU05854 | hypothetical protein | | | No Induction |
| NCU06214 | hypothetical protein | | | No Induction |
| NCU06312 | hypothetical protein | | | No Induction |
| NCU06704 | hypothetical protein | | | No Induction |

TABLE 1A-continued

Genes under regulation by cellulose in wild type *N. crassa* clustered by level of induction/repression in clr mutants

| Gene | Annotation | Group 1 | Group 2 | Cluster |
|---|---|---|---|---|
| NCU07207 | hypothetical protein | | | No Induction |
| NCU07336 | hypothetical protein | | | No Induction |
| NCU07339 | hypothetical protein | | | No Induction |
| NCU07453 | hypothetical protein | | | No Induction |
| NCU07897 | hypothetical protein | | | No Induction |
| NCU07979 | hypothetical protein | | | No Induction |
| NCU08043 | hypothetical protein | | | No Induction |
| NCU08113 | hypothetical protein | | | No Induction |
| NCU08117 | hypothetical protein | | | No Induction |
| NCU08379 | hypothetical protein | | | No Induction |
| NCU08624 | hypothetical protein | | | No Induction |
| NCU08784 | hypothetical protein | | | No Induction |
| NCU09003 | hypothetical protein | | | No Induction |
| NCU09426 | hypothetical protein | | | No Induction |
| NCU09479 | hypothetical protein | | | No Induction |
| NCU09522 | hypothetical protein | | | No Induction |
| NCU09523 | hypothetical protein | | | No Induction |
| NCU09689 | hypothetical protein | | | No Induction |
| NCU10521 | hypothetical protein | | | No Induction |
| NCU11118 | hypothetical protein | | | No Induction |
| NCU11278 | hypothetical protein | | | No Induction |
| NCU11327 | | | | No Induction |
| NCU11397 | | | | No Induction |
| NCU11690 | hypothetical protein | | | No Induction |
| NCU11722 | | | | No Induction |
| NCU11862 | hypothetical protein | | | No Induction |
| NCU00247 | hypothetical protein | | | No Repression |
| NCU01347 | hypothetical protein | | | No Repression |
| NCU01598 | methyltransferase | | | No Repression |
| NCU03761 | hypothetical protein | | | No Repression |
| NCU04635 | hypothetical protein | | | No Repression |
| NCU04667 | hypothetical protein | | | No Repression |
| NCU05058 | hypothetical protein | | | No Repression |
| NCU05128 | hypothetical protein | | | No Repression |
| NCU06265 | hypothetical protein | | | No Repression |
| NCU06615 | hypothetical protein | | | No Repression |
| NCU06895 | cytochrome P450 4A5 | | | No Repression |

TABLE 1A-continued

Genes under regulation by cellulose in wild type *N. crassa* clustered by level of induction/repression in clr mutants

| Gene | Annotation | Group 1 | Group 2 | Cluster |
|---|---|---|---|---|
| NCU07233 | hypothetical protein | | | No Repression |
| NCU07423 | hypothetical protein | | | No Repression |
| NCU07424 | hypothetical protein | | | No Repression |
| NCU07895 | hypothetical protein | | | No Repression |
| NCU08418 | tripeptidyl-peptidase | | | No Repression |
| NCU08557 | hypothetical protein | | | No Repression |
| NCU08712 | hypothetical protein | | | No Repression |
| NCU09060 | hypothetical protein | | | No Repression |
| NCU09231 | DUF1275 domain-containing protein | | | No Repression |
| NCU09685 | hypothetical protein | | | No Repression |
| NCU09958 | hypothetical protein | | | No Repression |
| NCU10276 | hypothetical protein | | | No Repression |
| NCU11697 | | | | No Repression |
| NCU11944 | | | | No Repression |
| NCU12051 | hypothetical protein | | | No Repression |
| NCU12128 | | | | No Repression |
| NCU12145 | hypothetical protein | | | No Repression |
| NCU00289 | hypothetical protein | | | Partial Induction |
| NCU00496 | hypothetical protein | | | Partial Induction |
| NCU00763 | hypothetical protein | | | Partial Induction |
| NCU01386 | hypothetical protein | | | Partial Induction |
| NCU02485 | hypothetical protein | | | Partial Induction |
| NCU02882 | hypothetical protein | | | Partial Induction |
| NCU04618 | hypothetical protein | | | Partial Induction |
| NCU04871 | hypothetical protein | | | Partial Induction |
| NCU04904 | hypothetical protein | | | Partial Induction |
| NCU05351 | hypothetical protein | | | Partial Induction |
| NCU05501 | hypothetical protein | | | Partial Induction |
| NCU05906 | hypothetical protein | | | Partial Induction |
| NCU06373 | hypothetical protein | | | Partial Induction |
| NCU07270 | hypothetical protein | | | Partial Induction |
| NCU08116 | hypothetical protein | | | Partial Induction |
| NCU08397 | hypothetical protein | | | Partial Induction |
| NCU08748 | hypothetical protein | | | Partial Induction |
| NCU08867 | hypothetical protein | | | Partial Induction |
| NCU09176 | hypothetical protein | | | Partial Induction |
| NCU11769 | | | | Partial Induction |

TABLE 1A-continued

Genes under regulation by cellulose in wild type *N. crassa* clustered by level of induction/repression in clr mutants

| Gene | Annotation | Group 1 | Group 2 | Cluster |
|---|---|---|---|---|
| NCU11828 | | | | Partial Induction |
| NCU11905 | | | | Partial Induction |
| NCU00011 | hypothetical protein | | | Partial Repression |
| NCU00397 | hypothetical protein | | | Partial Repression |
| NCU00510 | hypothetical protein | | | Partial Repression |
| NCU00935 | hypothetical protein | | | Partial Repression |
| NCU01880 | hypothetical protein | | | Partial Repression |
| NCU02080 | hypothetical protein | | | Partial Repression |
| NCU02130 | hypothetical protein | | | Partial Repression |
| NCU02163 | hypothetical protein | | | Partial Repression |
| NCU02365 | hypothetical protein | | | Partial Repression |
| NCU03157 | hypothetical protein | | | Partial Repression |
| NCU03352 | hypothetical protein | | | Partial Repression |
| NCU03398 | hypothetical protein | | | Partial Repression |
| NCU03570 | hypothetical protein | | | Partial Repression |
| NCU04282 | hypothetical protein | | | Partial Repression |
| NCU04342 | hypothetical protein | | | Partial Repression |
| NCU04360 | hypothetical protein | | | Partial Repression |
| NCU04525 | hypothetical protein | | | Partial Repression |
| NCU04866 | hypothetical protein | | | Partial Repression |
| NCU05784 | hypothetical protein | | | Partial Repression |
| NCU05951 | hypothetical protein | | | Partial Repression |
| NCU05976 | hypothetical protein | | | Partial Repression |
| NCU06156 | hypothetical protein | | | Partial Repression |
| NCU06986 | DUF221 domain-containing protein | | | Partial Repression |
| NCU07126 | hypothetical protein | | | Partial Repression |
| NCU07593 | hypothetical protein | | | Partial Repression |
| NCU07718 | hypothetical protein | | | Partial Repression |
| NCU08224 | hypothetical protein | | | Partial Repression |
| NCU08469 | hypothetical protein | | | Partial Repression |
| NCU08726 | hypothetical protein | | | Partial Repression |
| NCU09049 | hypothetical protein | | | Partial Repression |
| NCU09115 | cytochrome P450 52A11 | | | Partial Repression |
| NCU09883 | hypothetical protein | | | Partial Repression |
| NCU10658 | hypothetical protein | | | Partial Repression |
| NCU10770 | hypothetical protein | | | Partial Repression |
| NCU11294 | | | | Partial Repression |

TABLE 1A-continued

Genes under regulation by cellulose in wild type *N. crassa* clustered by level of induction/repression in clr mutants

| Gene | Annotation | Group 1 | Group 2 | Cluster |
|---|---|---|---|---|
| NCU00304 | hypothetical protein | | | WT Induction |
| NCU00798 | hypothetical protein | | | WT Induction |
| NCU01136 | hypothetical protein | | | WT Induction |
| NCU01430 | hypothetical protein | | | WT Induction |
| NCU03791 | hypothetical protein | | | WT Induction |
| NCU04167 | hypothetical protein | | | WT Induction |
| NCU04400 | hypothetical protein | | | WT Induction |
| NCU04557 | hypothetical protein | | | WT Induction |
| NCU04879 | hypothetical protein | | | WT Induction |
| NCU04910 | hypothetical protein | | | WT Induction |
| NCU04928 | hypothetical protein | | | WT Induction |
| NCU05068 | hypothetical protein | | | WT Induction |
| NCU05755 | hypothetical protein | | | WT Induction |
| NCU05826 | hypothetical protein | | | WT Induction |
| NCU05832 | hypothetical protein | | | WT Induction |
| NCU05875 | hypothetical protein | | | WT Induction |
| NCU05909 | hypothetical protein | | | WT Induction |
| NCU06181 | hypothetical protein | | | WT Induction |
| NCU06235 | hypothetical protein | | | WT Induction |
| NCU06387 | hypothetical protein | | | WT Induction |
| NCU07235 | hypothetical protein | | | WT Induction |
| NCU07510 | hypothetical protein | | | WT Induction |
| NCU07572 | hypothetical protein | | | WT Induction |
| NCU07997 | hypothetical protein | | | WT Induction |
| NCU08383 | hypothetical protein | | | WT Induction |
| NCU08491 | hypothetical protein | | | WT Induction |
| NCU08634 | hypothetical protein | | | WT Induction |
| NCU09075 | hypothetical protein | | | WT Induction |
| NCU09415 | hypothetical protein | | | WT Induction |
| NCU09856 | hypothetical protein | | | WT Induction |
| NCU09874 | hypothetical protein | | | WT Induction |
| NCU09906 | hypothetical protein | | | WT Induction |
| NCU10284 | | | | WT Induction |
| NCU10697 | hypothetical protein | | | WT Induction |
| NCU11095 | hypothetical protein | | | WT Induction |
| NCU11291 | hypothetical protein | | | WT Induction |
| NCU11689 | hypothetical protein | | | WT Induction |

TABLE 1A-continued

Genes under regulation by cellulose in wild type *N. crassa*
clustered by level of induction/repression in clr mutants

| Gene | Annotation | Group 1 | Group 2 | Cluster |
|---|---|---|---|---|
| NCU11801 | | | | WT Induction |
| NCU11932 | hypothetical protein | | | WT Induction |
| NCU00365 | hypothetical protein | | | WT Repression |
| NCU00375 | hypothetical protein | | | WT Repression |
| NCU00755 | hypothetical protein | | | WT Repression |
| NCU01109 | hypothetical protein | | | WT Repression |
| NCU01292 | hypothetical protein | | | WT Repression |
| NCU01551 | hypothetical protein | | | WT Repression |
| NCU01649 | hypothetical protein | | | WT Repression |
| NCU03011 | hypothetical protein | | | WT Repression |
| NCU03417 | hypothetical protein | | | WT Repression |
| NCU04285 | hypothetical protein | | | WT Repression |
| NCU04843 | hypothetical protein | | | WT Repression |
| NCU04851 | hypothetical protein | | | WT Repression |
| NCU04861 | hypothetical protein | | | WT Repression |
| NCU04862 | hypothetical protein | | | WT Repression |
| NCU05006 | cytochrome P450 | | | WT Repression |
| NCU05189 | hypothetical protein | | | WT Repression |
| NCU05197 | hypothetical protein | | | WT Repression |
| NCU05477 | hypothetical protein | | | WT Repression |
| NCU05762 | hypothetical protein | | | WT Repression |
| NCU05764 | hypothetical protein | | | WT Repression |
| NCU05766 | hypothetical protein | | | WT Repression |
| NCU05859 | hypothetical protein | | | WT Repression |
| NCU05933 | hypothetical protein | | | WT Repression |
| NCU06334 | hypothetical protein | | | WT Repression |
| NCU07180 | hypothetical protein | | | WT Repression |
| NCU07363 | hypothetical protein | | | WT Repression |
| NCU08037 | hypothetical protein | | | WT Repression |
| NCU08155 | hypothetical protein | | | WT Repression |
| NCU08156 | hypothetical protein | | | WT Repression |
| NCU08170 | hypothetical protein | | | WT Repression |
| NCU08455 | hypothetical protein | | | WT Repression |
| NCU08554 | peptidyl-prolyl cis-trans isomerase ssp-1 | | | WT Repression |
| NCU08622 | hypothetical protein | | | WT Repression |
| NCU08700 | hypothetical protein | | | WT Repression |
| NCU08775 | hypothetical protein | | | WT Repression |

TABLE 1A-continued

Genes under regulation by cellulose in wild type *N. crassa* clustered by level of induction/repression in clr mutants

| Gene | Annotation | Group 1 | Group 2 | Cluster |
|---|---|---|---|---|
| NCU09272 | hypothetical protein | | | WT Repression |
| NCU09273 | hypothetical protein | | | WT Repression |
| NCU09274 | hypothetical protein | | | WT Repression |
| NCU09335 | hypothetical protein | | | WT Repression |
| NCU09342 | hypothetical protein | | | WT Repression |
| NCU09714 | hypothetical protein | | | WT Repression |
| NCU09782 | hypothetical protein | | | WT Repression |
| NCU10062 | hypothetical protein | | | WT Repression |
| NCU10301 | hypothetical protein | | | WT Repression |
| NCU11565 | hypothetical protein | | | WT Repression |
| NCU11774 | | | | WT Repression |
| NCU11881 | hypothetical protein | | | WT Repression |
| NCU11974 | hypothetical protein | | | WT Repression |
| NCU11989 | hypothetical protein | | | WT Repression |
| NCU12012 | | | | WT Repression |
| NCU12014 | hypothetical protein | | | WT Repression |
| NCU12015 | hypothetical protein | | | WT Repression |

Annotation: Broad Institute Annotation
Group 1: Author's hand curated annotation category
Group 2: Author's hand curated annotation/function

TABLE 1B

Annotation information for genes in Table 1A

| Gene | CAZy | Signal P | Signal P Confidence | TM Domains | LCMS | Tian et al., MA | Tian et al. Annotation |
|---|---|---|---|---|---|---|---|
| NCU00554 | | Mitochondrion | 4 | | | | |
| NCU00944 | | Mitochondrion | 2 | | | | |
| NCU01195 | | Other | 1 | | | | |
| NCU02785 | | Other | 2 | | | | |
| NCU02954 | | Other | 2 | | | | |
| NCU03131 | | Mitochondrion | 1 | | | | |
| NCU04216 | | Other | 5 | | | | |
| NCU04298 | | Other | 2 | | | | |
| NCU04837 | | Other | 4 | | | | |
| NCU05548 | | Other | 2 | | | | |
| NCU07413 | | Other | 1 | | | | |
| NCU10283 | | Other | 5 | | | | |
| NCU00461 | | Other | 2 | | | | |
| NCU00591 | | Mitochondrion | 1 | | | | |
| NCU00680 | | Mitochondrion | 1 | | | | |
| NCU01402 | | Other | 1 | | | | |
| NCU02127 | | Mitochondrion | 2 | | | | |
| NCU02704 | | Mitochondrion | 1 | | | | |
| NCU02727 | | Mitochondrion | 2 | | | | |
| NCU02936 | | Mitochondrion | 2 | | | | |
| NCU03076 | | Mitochondrion | 1 | | | | |
| NCU03415 | | Other | 1 | | Avi/Mis | | |
| NCU03648 | | Secretory Pathway | 2 | | | | |
| NCU03913 | | Mitochondrion | 2 | | | | |
| NCU05499 | | Other | 2 | | | | |
| NCU05537 | | Other | 2 | | | | |

TABLE 1B-continued

Annotation information for genes in Table 1A

| Gene | CAZy | Signal P | Signal P Confidence | TM Domains | LCMS | Tian et al., MA | Tian et al. Annotation |
|---|---|---|---|---|---|---|---|
| NCU05977 | | Other | 2 | | | | |
| NCU06448 | | Mitochondrion | 1 | | | | |
| NCU06543 | | Mitochondrion | 1 | | | | |
| NCU07153 | | Mitochondrion | 2 | | | | |
| NCU08216 | | Other | 1 | | | | |
| NCU09116 | | Other | 2 | | | | |
| NCU09266 | | Mitochondrion | 1 | | | | |
| NCU09864 | | Mitochondrion | 1 | | | | |
| NCU11195 | | Mitochondrion | 3 | | | | |
| NCU01830 | | Other | 2 | | | | |
| NCU02126 | | Mitochondrion | 2 | | | | |
| NCU01744 | | Other | 1 | | | | |
| NCU03748 | | Other | 4 | | | | |
| NCU06625 | | Other | 3 | | | | |
| NCU04130 | | Other | 5 | | | | |
| NCU10110 | | Secretory Pathway | 5 | 1 | | | |
| NCU03861 | | Secretory Pathway | 1 | | | | |
| NCU07623 | | Other | 2 | | | | |
| NCU01427 | | Other | 3 | | | | |
| NCU03651 | | Mitochondrion | 3 | | | | |
| NCU02579 | | Secretory Pathway | 1 | | | | |
| NCU07307 | | Mitochondrion | 4 | | | | |
| NCU07308 | | Secretory Pathway | 4 | | | | |
| NCU05858 | | Other | 2 | | | | |
| NCU01013 | | Mitochondrion | 4 | | | | |
| NCU06189 | | Mitochondrion | 4 | | | | |
| NCU05165 | | Secretory Pathway | 1 | 1 | | | |
| NCU04865 | | Other | 2 | | | | |
| NCU05011 | | Other | 3 | | | | |
| NCU00762 | CBM1, GH5 | Secretory Pathway | 2 | | Avi/Mis | Avi/Mis | Cellulase |
| NCU00836 | CBM1, GH61 | Secretory Pathway | 4 | | | Avi/Mis | Cellulase |
| NCU01050 | GH61 | Secretory Pathway | 2 | | Avi/Mis | Avi/Mis | Cellulase |
| NCU02240 | CBM1, GH61 | Secretory Pathway | 2 | | Avi | Avi/Mis | Cellulase |
| NCU02344 | GH61 | Secretory Pathway | 4 | | | Avi/Mis | Cellulase |
| NCU02916 | CBM1, GH61 | Secretory Pathway | 3 | | | Avi/Mis | Cellulase |
| NCU03328 | GH61 | Secretory Pathway | 1 | | | Avi/Mis | Cellulase |
| NCU04854 | GH7 | Secretory Pathway | 2 | | | Avi/Mis | Cellulase |
| NCU05057 | GH7 | Secretory Pathway | 2 | | Avi/Mis | Avi/Mis | Cellulase |
| NCU05121 | CBM1, GH45 | Secretory Pathway | 2 | | Avi | Avi/Mis | Cellulase |
| NCU07190 | GH6 | Secretory Pathway | 3 | | Avi/Mis | Avi/Mis | Cellulase |
| NCU07340 | CBM1, GH7 | Secretory Pathway | 2 | | Avi/Mis | Avi/Mis | Cellulase |
| NCU07760 | CBM1, GH61 | Secretory Pathway | 2 | | | Mis | Cellulase |
| NCU07898 | GH61 | Secretory Pathway | 1 | | Avi/Mis | Avi/Mis | Cellulase |
| NCU08760 | CBM1, GH61 | Secretory Pathway | 1 | | Avi/Mis | Avi/Mis | Cellulase |
| NCU09680 | CBM1, GH6 | Secretory Pathway | 1 | | Avi/Mis | Avi/Mis | Cellulase |
| NCU03322 | | Other | 1 | | | | |
| NCU07362 | | Other | 2 | | | | |
| NCU03813 | | Other | 2 | | | | |
| NCU04539 | | Other | 3 | | | | |
| NCU08687 | | Other | 2 | | | | |
| NCU05133 | | Other | 2 | | | | |
| NCU09705 | | Secretory Pathway | 3 | | | Avi/Mis | |

TABLE 1B-continued

Annotation information for genes in Table 1A

| Gene | CAZy | Signal P | Signal P Confidence | TM Domains | LCMS | Tian et al., MA | Tian et al. Annotation |
|---|---|---|---|---|---|---|---|
| NCU07277 | | Secretory Pathway | 1 | | | Avi | |
| NCU04797 | | Other | 2 | | | | |
| NCU00575 | | Other | 1 | | | | |
| NCU04401 | | Other | 4 | | | Mis | |
| NCU02855 | GH11 | Secretory Pathway | 3 | | Avi | Avi/Mis | Hemicellulase |
| NCU05924 | GH10 | Secretory Pathway | 2 | | Avi/Mis | Avi/Mis | Hemicellulase |
| NCU05955 | CBM1, GH74 | Secretory Pathway | 2 | | Avi/Mis | Avi/Mis | Hemicellulase |
| NCU07326 | GH43 | Secretory Pathway | 1 | | Avi/Mis | Avi/Mis | Hemicellulase |
| NCU09775 | GH54 | Secretory Pathway | 1 | | Mis | Mis | Hemicellulase |
| NCU04997 | CBM1, GH10 | Secretory Pathway | 2 | | | | Hemicellulase |
| NCU01900 | GH43 | Other | 2 | | | Avi/Mis | Hemicellulase |
| NCU02343 | GH51 | Secretory Pathway | 1 | | Mis | Avi/Mis | Hemicellulase |
| NCU07225 | CBM1, GH11 | Secretory Pathway | 2 | | Avi/Mis | Avi/Mis | Hemicellulase |
| NCU08087 | GH26 | Other | 2 | | | | Hemicellulase |
| NCU08189 | GH10 | Secretory Pathway | 1 | | Avi/Mis | Avi/Mis | Hemicellulase |
| NCU09652 | GH43 | Other | 2 | | | Avi/Mis | Hemicellulase |
| NCU06881 | | Mitochondrion | 2 | | | | |
| NCU01853 | | Other | 2 | | | | |
| NCU02287 | | Other | 2 | | | | |
| NCU02894 | | Other | 3 | | | | |
| NCU07263 | | Other | 3 | 2 | | | |
| NCU08924 | | Other | 2 | | | | |
| NCU09692 | | Mitochondrion | 5 | 6 | | | |
| NCU04796 | | Other | 2 | | | | |
| NCU09732 | | Mitochondrion | 1 | | | | |
| NCU07719 | | Other | 2 | | | | |
| NCU12093 | | Other | 2 | | | | |
| NCU05818 | | Other | 3 | | | | |
| NCU04078 | | Mitochondrion | 2 | | | | |
| NCU07617 | | Other | 2 | | | | |
| NCU08398 | | Secretory Pathway | 4 | | Avi/Mis | Avi/Mis | |
| NCU10683 | | Other | 2 | | | | |
| NCU10063 | | Other | 2 | | | | |
| NCU04933 | | Secretory Pathway | 5 | | | | |
| NCU00890 | GH2 | Other | 3 | | | Avi | |
| NCU04623 | GH35 | Secretory Pathway | 4 | | | | |
| NCU04952 | GH3 | Secretory Pathway | 2 | | Avi/Mis | Avi | |
| NCU05956 | GH2 | Other | 4 | | | | |
| NCU07487 | GH3 | Other | 2 | | | Avi/Mis | |
| NCU08755 | GH3 | Secretory Pathway | 2 | | | Avi/Mis | |
| NCU00130 | GH1 | Other | 4 | | | Avi/Mis | |
| NCU00709 | GH3 | Secretory Pathway | 1 | | | | |
| NCU04168 | GH16 | Other | 2 | 1 | | | |
| NCU09904 | GH16 | Other | 1 | 1 | | Avi | |
| NCU09923 | GH3 | Secretory Pathway | 1 | | Mis | Mis | |
| NCU03098 | GH15 | Other | 4 | | | | |
| NCU09028 | GH47 | Mitochondrion | 3 | 1 | | | |
| NCU09281 | GH31 | Secretory Pathway | 1 | | | | |
| NCU10107 | | Other | 2 | | | | |
| NCU00206 | CBM1 | Secretory Pathway | 3 | | Avi/Mis | Avi/Mis | |
| NCU00710 | CBM1, CE1 | Secretory Pathway | 2 | | | Mis | |
| NCU01059 | GH47 | Secretory Pathway | 3 | 1 | | | |
| NCU03181 | | Secretory Pathway | 3 | | | Avi/Mis | |

TABLE 1B-continued

Annotation information for genes in Table 1A

| Gene | CAZy | Signal P | Signal P Confidence | TM Domains | LCMS | Tian et al., MA | Tian et al. Annotation |
|---|---|---|---|---|---|---|---|
| NCU04494 | CE1 | Secretory Pathway | 1 | | | | Mis |
| NCU05598 | PL4 | Secretory Pathway | 1 | 1 | | | Avi/Mis |
| NCU05751 | CE3 | Secretory Pathway | 1 | | Mis | | Mis |
| NCU08176 | PL3 | Secretory Pathway | 2 | | | | Avi/Mis |
| NCU08746 | CBM20 | Secretory Pathway | 3 | | | | Avi/Mis |
| NCU08785 | CE1 | Secretory Pathway | 1 | | Mis | | Avi/Mis |
| NCU09445 | CE15 | Secretory Pathway | 1 | | | | |
| NCU09491 | CE1 | Secretory Pathway | 2 | | Avi/Mis | Mis | |
| NCU09582 | CE4 | Secretory Pathway | 1 | | | | Avi/Mis |
| NCU09764 | CBM1 | Secretory Pathway | 1 | | | | Avi/Mis |
| NCU09774 | CE1 | Secretory Pathway | 1 | | | | Avi |
| NCU09976 | CE12 | Secretory Pathway | 4 | | | | Mis |
| NCU10045 | CE8 | Secretory Pathway | 1 | | | | Avi/Mis |
| NCU11068 | | Other | 3 | | | | |
| NCU11198 | GH53 | Secretory Pathway | 1 | | | | |
| NCU02904 | | Secretory Pathway | 1 | | | | |
| NCU04870 | CE1 | Secretory Pathway | 1 | | Mis | | Mis |
| NCU05159 | CBM1, CE5 | Secretory Pathway | 1 | | Mis | | Avi/Mis |
| NCU09518 | | Secretory Pathway | 1 | | | | |
| NCU09664 | CE5 | Secretory Pathway | 1 | | | | Avi/Mis |
| NCU09924 | GH93 | Secretory Pathway | 1 | | | | Mis |
| NCU03158 | | Secretory Pathway | 4 | 1 | | | |
| NCU07067 | GH47 | Secretory Pathway | 1 | 3 | | | |
| NCU01353 | GH16 | Secretory Pathway | 3 | | | | |
| NCU07269 | GH92 | Secretory Pathway | 2 | | | | |
| NCU06023 | | Other | 3 | | | | |
| NCU06025 | | Other | 4 | | | | |
| NCU00761 | | Secretory Pathway | 1 | | | | |
| NCU06650 | | Secretory Pathway | 1 | | | | |
| NCU09416 | CBM1, CE16 | Secretory Pathway | 1 | | | | Avi |
| NCU00292 | | Secretory Pathway | 2 | | | | |
| NCU03903 | | Secretory Pathway | 2 | | | | |
| NCU04475 | | Secretory Pathway | 1 | | | | Mis |
| NCU06364 | | Secretory Pathway | 2 | | | | |
| NCU09575 | | Secretory Pathway | 3 | | | | |
| NCU04230 | | Other | 1 | | | | |
| NCU02366 | | Mitochondrion | 2 | | | | |
| NCU04280 | | Mitochondrion | 2 | | | | |
| NCU04385 | | Other | 2 | | | | |
| NCU02969 | | Other | 3 | 6 | | | |
| NCU08164 | | Other | 2 | | | | |
| NCU00891 | | Other | 2 | | | | Mis |
| NCU08384 | | Other | 2 | | | | Avi/Mis |

TABLE 1B-continued

Annotation information for genes in Table 1A

| Gene | CAZy | Signal P | Signal P Confidence | TM Domains | LCMS | Tian et al., MA | Tian et al. Annotation |
|---|---|---|---|---|---|---|---|
| NCU08272 | | Other | 1 | | | | |
| NCU07619 | | Secretory Pathway | 2 | | | | |
| NCU05304 | | Other | 2 | | | | |
| NCU01510 | | Other | 1 | 1 | | | |
| NCU05768 | | Secretory Pathway | 1 | | | | |
| NCU07154 | | Other | 3 | | | | |
| NCU01998 | | Mitochondrion | 4 | | | | |
| NCU08457 | | Secretory Pathway | 1 | | | | |
| NCU06386 | GT2 | Secretory Pathway | 2 | 1 | | | |
| NCU09425 | GH94 | Other | 5 | | | | |
| NCU02478 | GT5, GH13 | Secretory Pathway | 2 | 13 | | | |
| NCU09175 | GH17 | Secretory Pathway | 3 | | Avi/Mis | Avi/Mis | |
| NCU01689 | | Other | 3 | | | | |
| NCU11721 | | Mitochondrion | 5 | | | | |
| NCU02396 | | Other | 2 | | | | |
| NCU07481 | | Other | 2 | | | | |
| NCU03137 | | Other | 2 | | | | |
| NCU02500 | | Secretory Pathway | 2 | | | Avi | |
| NCU00565 | | Mitochondrion | 1 | | | | |
| NCU02705 | | Mitochondrion | 1 | | | | |
| NCU05225 | | Mitochondrion | 2 | 1 | | | |
| NCU08326 | | Other | 2 | | | | |
| NCU00326 | | Other | 1 | | | Avi/Mis | |
| NCU08691 | | Other | 3 | | | | |
| NCU09043 | | Other | 1 | 1 | | | |
| NCU07432 | | Secretory Pathway | 1 | 4 | | | |
| NCU05841 | | Other | 2 | | | | |
| NCU02361 | | Other | 1 | | | | |
| NCU10051 | | Other | 4 | | | | |
| NCU04720 | | Other | 3 | | | | |
| NCU04698 | | Other | 2 | 1 | | | |
| NCU00177 | | Mitochondrion | 5 | | | | |
| NCU01786 | | Other | 2 | | | | |
| NCU03117 | | Other | 2 | | | | |
| NCU05254 | | Other | 2 | | | | |
| NCU03963 | | Other | 2 | | | | |
| NCU09659 | | Secretory Pathway | 2 | | | | |
| NCU03488 | | Other | 3 | | | | |
| NCU02657 | | Other | 2 | | | | |
| NCU05855 | | Other | 5 | | | Avi | |
| NCU08044 | | Mitochondrion | 2 | | | | |
| NCU09283 | | Other | 2 | | | | |
| NCU11243 | | Other | 3 | | | | |
| NCU01378 | | Other | 4 | | | | |
| NCU01861 | | Mitochondrion | 1 | | | | |
| NCU04583 | | Mitochondrion | 4 | | | | |
| NCU06616 | | Mitochondrion | 2 | | | | |
| NCU07325 | | Other | 1 | | | Avi | |
| NCU08771 | | Other | 4 | | | | |
| NCU09553 | | Mitochondrion | 2 | | | | |
| NCU10055 | | Other | 3 | 7 | | | |
| NCU11289 | | Other | 3 | | | | |
| NCU08750 | | Secretory Pathway | 1 | | | Avi/Mis | |
| NCU08752 | | Secretory Pathway | 1 | | | | |
| NCU03049 | | Other | 2 | | | | |
| NCU05653 | | Secretory Pathway | 4 | | | | |
| NCU07133 | | Other | 3 | | | | |
| NCU08925 | | Other | 3 | | | | |
| NCU09865 | | Other | 2 | | | | |
| NCU11365 | | Other | 2 | | | | |
| NCU07055 | | Secretory Pathway | 3 | | | | |

TABLE 1B-continued

Annotation information for genes in Table 1A

| Gene | CAZy | Signal P | Signal P Confidence | TM Domains | LCMS | Tian et al., MA | Tian et al. Annotation |
|---|---|---|---|---|---|---|---|
| NCU07224 | | Secretory Pathway | 2 | | | | |
| NCU01061 | | Other | 4 | | | | |
| NCU03566 | | Other | 4 | | | | |
| NCU04260 | | Other | 3 | | | | |
| NCU05094 | | Other | 4 | 1 | | | |
| NCU05986 | | Other | 3 | | | | |
| NCU06153 | | Other | 2 | 1 | | | |
| NCU09674 | | Other | 1 | | | | |
| NCU11241 | | Other | 1 | | | | |
| NCU03013 | | Secretory Pathway | 3 | | | Mis | |
| NCU05319 | | Other | 3 | | | Avi/Mis | |
| NCU04430 | | Secretory Pathway | 2 | | | | |
| NCU02059 | | Secretory Pathway | 2 | | | Mis | |
| NCU00831 | | Secretory Pathway | 3 | | | | |
| NCU06055 | | Secretory Pathway | 2 | | | | |
| NCU00263 | | Secretory Pathway | 2 | | | Mis | |
| NCU07200 | | Secretory Pathway | 1 | | | | |
| NCU09992 | | Secretory Pathway | 3 | | | Mis | |
| NCU09265 | | Secretory Pathway | 4 | 1 | | Mis | |
| NCU00813 | | Secretory Pathway | 2 | | | Avi/Mis | |
| NCU02455 | | Secretory Pathway | 1 | | | Mis | |
| NCU09223 | | Secretory Pathway | 2 | | | Avi/Mis | |
| NCU09485 | | Secretory Pathway | 1 | 1 | | Mis | |
| NCU01648 | GT39 | Other | 2 | 9 | | | |
| NCU10497 | | Other | 3 | 13 | | | |
| NCU00669 | | Secretory Pathway | 1 | 1 | | | |
| NCU02118 | | Secretory Pathway | 3 | 4 | | | |
| NCU10762 | | Secretory Pathway | 5 | 1 | | | |
| NCU00244 | GT8 | Other | 3 | | | | |
| NCU01068 | | Other | 2 | | | | |
| NCU03319 | | Other | 5 | 6 | | Mis | |
| NCU08761 | | Secretory Pathway | 2 | | | | |
| NCU01279 | | Secretory Pathway | 1 | 1 | | | |
| NCU03819 | | Other | 2 | | | | |
| NCU08607 | | Other | 4 | 2 | | Mis | |
| NCU09195 | | Other | 5 | 7 | | | |
| NCU07736 | | Other | 2 | 14 | | | |
| NCU01290 | | Other | 2 | | | | |
| NCU03396 | | Other | 2 | | | | |
| NCU09521 | | Other | 1 | | | | |
| NCU03897 | | Other | 1 | | | | |
| NCU07746 | | Other | 1 | | | | |
| NCU08897 | | Secretory Pathway | 4 | 8 | | | |
| NCU00169 | | Other | 3 | 3 | | | |
| NCU02681 | | Secretory Pathway | 1 | 1 | | | |
| NCU06333 | | Other | 2 | 2 | | Mis | |
| NCU01146 | | Secretory Pathway | 1 | 1 | | | |
| NCU00931 | | Other | 3 | | | | |
| NCU07008 | | Other | 1 | | | | |
| NCU03295 | | Other | 2 | | | | |
| NCU07737 | | Other | 3 | | | Avi/Mis | |
| NCU08038 | | Secretory Pathway | 1 | 1 | | Mis | |

TABLE 1B-continued

Annotation information for genes in Table 1A

| Gene | CAZy | Signal P | Signal P Confidence | TM Domains | LCMS | Tian et al., MA | Tian et al. Annotation |
|------|------|----------|---------------------|------------|------|-----------------|------------------------|
| NCU02729 | | Other | 5 | | | | |
| NCU03364 | | Mitochondrion | 4 | | | | |
| NCU03817 | | Mitochondrion | 1 | | | | |
| NCU06111 | | Mitochondrion | 5 | | | | |
| NCU08115 | | Mitochondrion | 5 | | | | |
| NCU06931 | | Mitochondrion | 2 | | | | |
| NCU04077 | | Other | 3 | | | | |
| NCU01862 | | Other | 2 | | | | |
| NCU02795 | | Other | 2 | | | | |
| NCU00812 | | Mitochondrion | 4 | | | | |
| NCU01856 | | Other | 1 | | | | |
| NCU03725 | | Other | 2 | | | | |
| NCU06971 | | Mitochondrion | 5 | | | | |
| NCU07705 | | Other | 4 | | | Avi/Mis | |
| NCU08042 | | Other | 3 | | | | |
| NCU03643 | | Other | 1 | | | | |
| NCU03043 | | Other | 3 | | | | |
| NCU05767 | | Other | 3 | | | | |
| NCU00316 | | Other | 4 | 2 | | | |
| NCU00721 | | Other | 2 | 12 | | | |
| NCU07578 | | Other | 5 | | | | |
| NCU04435 | | Other | 1 | 12 | | | |
| NCU05198 | | Other | 1 | 11 | | | |
| NCU10721 | | Other | 4 | 8 | | | |
| NCU11342 | | Other | 2 | | | | |
| NCU00821 | | Secretory Pathway | 2 | 1 | | | |
| NCU08561 | | Other | 2 | | | | |
| NCU09287 | | Other | 1 | 11 | | | |
| NCU00801 | | Other | 1 | 12 | | Avi/Mis | |
| NCU00809 | | Other | 1 | 12 | | | |
| NCU07668 | | Other | 5 | | | | |
| NCU05089 | | Other | 2 | 12 | | | |
| NCU08152 | | Secretory Pathway | 1 | 12 | | | |
| NCU01633 | | Other | 2 | 12 | | | |
| NCU04537 | | Other | 1 | 12 | | | |
| NCU05853 | | Other | 2 | 11 | | Avi/Mis | |
| NCU08114 | | Other | 2 | 9 | | Avi/Mis | |
| NCU00023 | | Mitochondrion | 4 | 6 | | | |
| NCU02009 | | Other | 3 | 5 | | | |
| NCU07068 | | Secretory Pathway | 4 | 12 | | | |
| NCU03305 | | Other | 3 | 9 | | | |
| NCU08225 | | Secretory Pathway | 2 | 7 | | | |
| NCU08147 | | Other | 1 | 1 | | | |
| NCU06366 | | Other | 3 | | | | |
| NCU05585 | | Other | 3 | 1 | | Mis | |
| NCU06138 | | Other | 5 | 11 | | Avi/Mis | |
| NCU05591 | | Other | 4 | 13 | | | |
| NCU06032 | | Secretory Pathway | 2 | | | | |
| NCU09098 | | Secretory Pathway | 1 | 12 | | | |
| NCU10009 | | Other | 2 | 13 | | | |
| NCU00290 | | Other | 2 | 6 | | Avi | |
| NCU09580 | | Other | 1 | | | | |
| NCU00803 | | Other | 3 | 12 | | | |
| NCU04374 | | Other | 1 | 12 | | | |
| NCU08425 | | Secretory Pathway | 2 | 1 | | | |
| NCU04097 | | Other | 2 | | | | |
| NCU05079 | | Other | 1 | 11 | | | |
| NCU07546 | | Other | 1 | 12 | | Avi | |
| NCU08148 | | Other | 1 | | | | |
| NCU03107 | | Other | 3 | 1 | | | |
| NCU00586 | | Secretory Pathway | 1 | 4 | | | |
| NCU00716 | | Secretory Pathway | 1 | | | | |
| NCU00025 | | Secretory Pathway | 1 | 9 | | | |
| NCU00848 | | Other | 1 | 6 | | | |

TABLE 1B-continued

Annotation information for genes in Table 1A

| Gene | CAZy | Signal P | Signal P Confidence | TM Domains | LCMS | Tian et al., MA | Tian et al. Annotation |
|---|---|---|---|---|---|---|---|
| NCU00449 | | Secretory Pathway | 1 | | | | |
| NCU00849 | | Secretory Pathway | 3 | | | | |
| NCU01058 | | Secretory Pathway | 4 | | | | |
| NCU01076 | | Secretory Pathway | 1 | 1 | | Avi | |
| NCU01196 | | Secretory Pathway | 1 | | | | |
| NCU01978 | | Secretory Pathway | 1 | 8 | | | |
| NCU02138 | | Secretory Pathway | 1 | 1 | | | |
| NCU03083 | | Secretory Pathway | 2 | | | | |
| NCU03982 | | Secretory Pathway | 1 | 1 | | Avi/Mis | |
| NCU04948 | | Secretory Pathway | 1 | | | | |
| NCU05230 | | Secretory Pathway | 1 | 4 | | | |
| NCU05863 | | Secretory Pathway | 5 | | | | |
| NCU05864 | | Secretory Pathway | 2 | | | Avi/Mis | |
| NCU06152 | | Secretory Pathway | 2 | 1 | | | |
| NCU06607 | | Secretory Pathway | 2 | | | Avi | |
| NCU08756 | | Secretory Pathway | 2 | | | | |
| NCU08790 | | Secretory Pathway | 1 | | | | |
| NCU09295 | | Secretory Pathway | 1 | 1 | | | |
| NCU09524 | | Secretory Pathway | 5 | | | Avi/Mis | |
| NCU11268 | | Secretory Pathway | 4 | | | | |
| NCU11542 | | Secretory Pathway | 1 | | | | |
| NCU11753 | | Secretory Pathway | 2 | | | | |
| NCU00175 | | Secretory Pathway | 3 | | | | |
| NCU00250 | | Secretory Pathway | 1 | 2 | | | |
| NCU00322 | | Secretory Pathway | 2 | | | | |
| NCU00695 | | Secretory Pathway | 3 | | | Avi | |
| NCU07311 | | Secretory Pathway | 1 | 4 | | | |
| NCU08171 | | Secretory Pathway | 2 | | | | |
| NCU08521 | | Secretory Pathway | 1 | 2 | | | |
| NCU10507 | | Secretory Pathway | 1 | | | | |
| NCU07143 | | Secretory Pathway | 1 | | Avi/Mis | Avi/Mis | |
| NCU07222 | | Secretory Pathway | 1 | | | | |
| NCU08371 | | Secretory Pathway | 2 | 1 | | Mis | |
| NCU09506 | | Secretory Pathway | 1 | | | | |
| NCU04106 | | Secretory Pathway | 5 | 6 | | | |
| NCU06526 | | Secretory Pathway | 3 | 1 | | | |
| NCU09196 | | Secretory Pathway | 2 | | | | |

TABLE 1B-continued

Annotation information for genes in Table 1A

| Gene | CAZy | Signal P | Signal P Confidence | TM Domains | LCMS | Tian et al., MA | Tian et al. Annotation |
|---|---|---|---|---|---|---|---|
| NCU11466 | | Secretory Pathway | 4 | | | | |
| NCU11957 | | Secretory Pathway | 5 | | | | |
| NCU00995 | | Secretory Pathway | 4 | | | | |
| NCU01720 | | Secretory Pathway | 2 | | | | |
| NCU03293 | | Secretory Pathway | 1 | | | | |
| NCU04169 | | Secretory Pathway | 1 | | | Avi | |
| NCU04170 | | Secretory Pathway | 2 | | | | |
| NCU04467 | | Secretory Pathway | 1 | | | | |
| NCU04932 | | Secretory Pathway | 2 | | | | |
| NCU04998 | | Secretory Pathway | 1 | | | | |
| NCU05134 | | Secretory Pathway | 1 | | Avi | Avi/Mis | |
| NCU05350 | | Secretory Pathway | 1 | 4 | | | |
| NCU05829 | | Secretory Pathway | 3 | 7 | | | |
| NCU05852 | | Secretory Pathway | 1 | | | | |
| NCU05908 | | Secretory Pathway | 2 | | | | |
| NCU06143 | | Secretory Pathway | 2 | | | Avi/Mis | |
| NCU06983 | | Secretory Pathway | 2 | | | | |
| NCU06991 | | Secretory Pathway | 1 | 3 | | | |
| NCU08635 | | Secretory Pathway | 4 | | | | |
| NCU09046 | | Secretory Pathway | 1 | | | | |
| NCU09172 | | Secretory Pathway | 5 | 12 | | | |
| NCU09424 | | Secretory Pathway | 1 | | | | |
| NCU09498 | | Secretory Pathway | 3 | | | Avi | |
| NCU09823 | | Secretory Pathway | 1 | 7 | | | |
| NCU09848 | | Secretory Pathway | 2 | | | | |
| NCU10014 | | Secretory Pathway | 2 | | | Avi/Mis | |
| NCU10039 | | Secretory Pathway | 3 | 1 | | | |
| NCU10687 | | Secretory Pathway | 2 | | | | |
| NCU00561 | | Secretory Pathway | 2 | 1 | | | |
| NCU00859 | | Secretory Pathway | 1 | | | | |
| NCU02042 | | Secretory Pathway | 1 | 1 | | | |
| NCU02164 | | Secretory Pathway | 1 | 1 | | | |
| NCU04482 | | Secretory Pathway | 1 | | | Avi | |
| NCU04486 | | Secretory Pathway | 1 | 3 | | | |
| NCU05236 | | Secretory Pathway | 5 | 1 | | | |
| NCU05761 | | Secretory Pathway | 5 | | | | |

TABLE 1B-continued

Annotation information for genes in Table 1A

| Gene | CAZy | Signal P | Signal P Confidence | TM Domains | LCMS | Tian et al., MA | Tian et al. Annotation |
|---|---|---|---|---|---|---|---|
| NCU05763 | | Secretory Pathway | 1 | 1 | | | |
| NCU06328 | | Secretory Pathway | 1 | 6 | | | |
| NCU07948 | | Secretory Pathway | 1 | | | | |
| NCU08140 | | Secretory Pathway | 2 | | | | |
| NCU08447 | | Secretory Pathway | 1 | 7 | | | |
| NCU09734 | | Secretory Pathway | 2 | 1 | | | |
| NCU12011 | | Secretory Pathway | 1 | | | | |
| NCU00408 | | Other | 1 | | | | |
| NCU00633 | | Other | 2 | | | | |
| NCU00870 | | Other | 4 | | | Avi/Mis | |
| NCU00871 | | Other | 2 | | | | |
| NCU00965 | | Other | 2 | 2 | | | |
| NCU01003 | | Other | 3 | | | | |
| NCU01049 | | Other | 3 | | | | |
| NCU01077 | | Other | 1 | | | | |
| NCU01148 | | Other | 2 | | | | |
| NCU01944 | | Other | 4 | | | | |
| NCU01970 | | Other | 3 | | | Avi/Mis | |
| NCU01983 | | Mitochondrion | 2 | | | | |
| NCU02008 | | Mitochondrion | 3 | | | | |
| NCU02061 | | Mitochondrion | 2 | | | | |
| NCU02600 | | Mitochondrion | 4 | | | | |
| NCU02625 | | Mitochondrion | 5 | 1 | | | |
| NCU02720 | | Other | 4 | | | | |
| NCU02915 | | Other | 3 | | | | |
| NCU03152 | | Other | 2 | | | | |
| NCU03329 | | Other | 2 | | | | |
| NCU03433 | | Other | 3 | | | | |
| NCU04127 | | Other | 1 | 1 | | | |
| NCU04522 | | Other | 3 | | | | |
| NCU04830 | | Other | 2 | | | | |
| NCU04905 | | Other | 1 | | | Avi/Mis | |
| NCU05056 | | Other | 2 | | | | |
| NCU05170 | | Other | 2 | 1 | | | |
| NCU05569 | | Other | 4 | | | | |
| NCU05574 | | Other | 3 | | | | |
| NCU05846 | | Mitochondrion | 5 | | | Avi/Mis | |
| NCU05848 | | Secretory Pathway | 2 | 1 | | | |
| NCU05854 | | Other | 4 | 7 | | | |
| NCU06214 | | Other | 4 | | | | |
| NCU06312 | | Other | 3 | 7 | | | |
| NCU06704 | | Other | 5 | 1 | | | |
| NCU07207 | | Other | 2 | | | | |
| NCU07336 | | Other | 4 | | | | |
| NCU07339 | | Other | 4 | 1 | | | |
| NCU07453 | | Other | 2 | | | | |
| NCU07897 | | Other | 1 | | | | |
| NCU07979 | | Other | 4 | | | | |
| NCU08043 | | Other | 3 | | | | |
| NCU08113 | | Other | 2 | | | | |
| NCU08117 | | Other | 4 | | | | |
| NCU08379 | | Mitochondrion | 4 | 1 | | | |
| NCU08624 | | Other | 3 | 6 | | | |
| NCU08784 | | Other | 3 | | | | |
| NCU09003 | | Other | 5 | | | | |
| NCU09426 | | Other | 4 | | | | |
| NCU09479 | | Other | 3 | 1 | | | |
| NCU09522 | | Other | 5 | | | | |
| NCU09523 | | Other | 4 | | | | |
| NCU09689 | | Other | 1 | | | Avi/Mis | |
| NCU10521 | | Other | 5 | | | | |
| NCU11118 | | Mitochondrion | 3 | | | | |
| NCU11278 | | Other | 3 | | | | |
| NCU11327 | | | | | | | |
| NCU11397 | | | | | | | |
| NCU11690 | | Other | 3 | | | | |
| NCU11722 | | | | | | | |

TABLE 1B-continued

Annotation information for genes in Table 1A

| Gene | CAZy | Signal P | Signal P Confidence | TM Domains | LCMS | Tian et al., MA | Tian et al. Annotation |
|---|---|---|---|---|---|---|---|
| NCU11862 | | Other | 1 | | | | |
| NCU00247 | | Mitochondrion | 5 | 1 | | | |
| NCU01347 | | Mitochondrion | 5 | | | | |
| NCU01598 | | Other | 2 | | | | |
| NCU03761 | | Other | 3 | | | | |
| NCU04635 | | Other | 1 | | | Mis | |
| NCU04667 | | Other | 2 | | | | |
| NCU05058 | | Other | 1 | | | | |
| NCU05128 | | Other | 3 | | | | |
| NCU06265 | | Other | 2 | | | | |
| NCU06615 | | Mitochondrion | 3 | | | Avi | |
| NCU06895 | | Secretory Pathway | 1 | 1 | | | |
| NCU07233 | | Other | 4 | 1 | | | |
| NCU07423 | | Mitochondrion | 1 | | | | |
| NCU07424 | | Other | 5 | | | | |
| NCU07895 | | Other | 5 | | | | |
| NCU08418 | | Mitochondrion | 5 | | | | |
| NCU08557 | | Other | 1 | | | | |
| NCU08712 | | Mitochondrion | 2 | | | | |
| NCU09060 | | Other | 2 | | | | |
| NCU09231 | | Other | 3 | 4 | | | |
| NCU09685 | | Mitochondrion | 5 | 1 | | | |
| NCU09958 | | Other | 4 | | | | |
| NCU10276 | | Other | 2 | 11 | | | |
| NCU11697 | | | | | | | |
| NCU11944 | | | | | | | |
| NCU12051 | | Mitochondrion | 4 | | | | |
| NCU12128 | | | | | | | |
| NCU12145 | | Other | 2 | | | | |
| NCU00289 | | Other | 2 | | | | |
| NCU00496 | | Other | 3 | | | | |
| NCU00763 | | Other | 2 | | | | |
| NCU01386 | | Other | 1 | | | | |
| NCU02485 | | Other | 2 | | | Mis | |
| NCU02882 | | Other | 3 | | | | |
| NCU04618 | | Other | 2 | | | | |
| NCU04871 | | Mitochondrion | 5 | | | | |
| NCU04904 | | Other | 3 | | | | |
| NCU05351 | | Mitochondrion | 4 | | | | |
| NCU05501 | | Other | 2 | | | Mis | |
| NCU05906 | | Other | 2 | | | | |
| NCU06373 | | Mitochondrion | 5 | | | | |
| NCU07270 | | Other | 2 | | | | |
| NCU08116 | | Other | 5 | | | | |
| NCU08397 | | Other | 1 | 11 | | Avi/Mis | |
| NCU08748 | | Other | 1 | 11 | | | |
| NCU08867 | | Other | 5 | 1 | | | |
| NCU09176 | | Other | 3 | | | | |
| NCU11769 | | | | | | | |
| NCU11828 | | | | | | | |
| NCU11905 | | | | | | | |
| NCU00011 | | Mitochondrion | 3 | | | | |
| NCU00397 | | Other | 4 | | | | |
| NCU00510 | | Mitochondrion | 4 | | | | |
| NCU00935 | | Other | 1 | | | | |
| NCU01880 | | Other | 3 | | | | |
| NCU02080 | | Mitochondrion | 4 | | | | |
| NCU02130 | | Other | 4 | | | | |
| NCU02163 | | Other | 4 | | | | |
| NCU02365 | | Other | 2 | | | | |
| NCU03157 | | Mitochondrion | 5 | | | | |
| NCU03352 | | Other | 1 | | | | |
| NCU03398 | | Other | 3 | | | | |
| NCU03570 | | Mitochondrion | 5 | | | | |
| NCU04282 | | Other | 2 | | | | |
| NCU04342 | | Other | 2 | | | | |
| NCU04360 | | Other | 2 | | | | |
| NCU04525 | | Other | 2 | | | | |
| NCU04866 | | Other | 4 | | | | |
| NCU05784 | | Other | 1 | | | | |
| NCU05951 | | Other | 4 | 1 | | | |
| NCU05976 | | Other | 4 | | | | |
| NCU06156 | | Other | 1 | | | | |
| NCU06986 | | Other | 4 | 11 | | | |

TABLE 1B-continued

Annotation information for genes in Table 1A

| Gene | CAZy | Signal P | Signal P Confidence | TM Domains | LCMS | Tian et al., MA | Tian et al. Annotation |
|---|---|---|---|---|---|---|---|
| NCU07126 | | Other | 1 | | | | |
| NCU07593 | | Other | 5 | | | | |
| NCU07718 | | Other | 2 | | | | |
| NCU08224 | | Mitochondrion | 4 | | | Mis | |
| NCU08469 | | Other | 3 | | | | |
| NCU08726 | | Other | 2 | | | | |
| NCU09049 | | Mitochondrion | 5 | 4 | | | |
| NCU09115 | | Other | 3 | 1 | | | |
| NCU09883 | | Mitochondrion | 5 | 7 | | Avi | |
| NCU10658 | | Other | 2 | | | | |
| NCU10770 | | Other | 2 | | | | |
| NCU11294 | | | | | | | |
| NCU00304 | | Mitochondrion | 3 | | | Mis | |
| NCU00798 | | Mitochondrion | 5 | | Avi | Avi | |
| NCU01136 | | Other | 5 | | | | |
| NCU01430 | | Other | 2 | | | Mis | |
| NCU03791 | | Mitochondrion | 2 | | | | |
| NCU04167 | | Other | 2 | 7 | | | |
| NCU04400 | | Other | 5 | | | Mis | |
| NCU04557 | | Mitochondrion | 2 | | | | |
| NCU04879 | | Other | 5 | | | | |
| NCU04910 | | Other | 3 | | | Avi/Mis | |
| NCU04928 | | Other | 2 | | | | |
| NCU05068 | | Other | 3 | 7 | | Avi | |
| NCU05755 | | Other | 2 | | | Mis | |
| NCU05826 | | Other | 1 | 1 | | | |
| NCU05832 | | Mitochondrion | 5 | | | | |
| NCU05875 | | Other | 2 | | | | |
| NCU05909 | | Mitochondrion | 4 | | | | |
| NCU06181 | | Mitochondrion | 4 | | | | |
| NCU06235 | | Other | 2 | | | | |
| NCU06387 | | Other | 4 | | | Mis | |
| NCU07235 | | Other | 3 | | | | |
| NCU07510 | | Other | 2 | | | | |
| NCU07572 | | Other | 1 | | | | |
| NCU07997 | | Other | 2 | | | Avi/Mis | |
| NCU08383 | | Mitochondrion | 5 | | | | |
| NCU08491 | | Other | 5 | | | | |
| NCU08634 | | Mitochondrion | 4 | | | | |
| NCU09075 | | Other | 1 | | | | |
| NCU09415 | | Other | 2 | | | | |
| NCU09856 | | Other | 2 | | | | |
| NCU09874 | | Other | 1 | 13 | | | |
| NCU09906 | GTNC | Other | 3 | 7 | | Avi | |
| NCU10284 | | | | | | | |
| NCU10697 | | Mitochondrion | 2 | | | | |
| NCU11095 | | Other | 2 | | | | |
| NCU11291 | | Other | 4 | | | | |
| NCU11689 | | Other | 4 | | | | |
| NCU11801 | | | | | | | |
| NCU11932 | | Mitochondrion | 1 | | | | |
| NCU00365 | | Other | 4 | | | | |
| NCU00375 | | Other | 5 | | | | |
| NCU00755 | | Mitochondrion | 4 | 11 | | | |
| NCU01109 | | Mitochondrion | 5 | | | | |
| NCU01292 | | Other | 4 | | | | |
| NCU01551 | | Mitochondrion | 5 | | | | |
| NCU01649 | | Other | 2 | | | | |
| NCU03011 | | Mitochondrion | 3 | | | | |
| NCU03417 | | Other | 3 | | | | |
| NCU04285 | | Other | 4 | | | | |
| NCU04843 | | Other | 3 | | | | |
| NCU04851 | | Other | 2 | | | | |
| NCU04861 | | Other | 4 | | | | |
| NCU04862 | | Other | 2 | | | | |
| NCU05006 | | Other | 4 | | | | |
| NCU05189 | | Other | 2 | 5 | | | |
| NCU05197 | | Other | 2 | | | | |
| NCU05477 | | Other | 4 | | | | |
| NCU05762 | | Other | 5 | | | | |
| NCU05764 | | Other | 1 | | | | |
| NCU05766 | | Other | 3 | | | | |
| NCU05859 | | Other | 3 | | | | |
| NCU05933 | | Other | 2 | | | | |
| NCU06334 | | Other | 3 | | | | |

TABLE 1B-continued

Annotation information for genes in Table 1A

| Gene | CAZy | Signal P | Signal P Confidence | TM Domains | LCMS | Tian et al., MA | Tian et al. Annotation |
|---|---|---|---|---|---|---|---|
| NCU07180 | | Other | 2 | | | | |
| NCU07363 | | Other | 3 | 1 | | | |
| NCU08037 | | Other | 2 | | | | |
| NCU08155 | | Mitochondrion | 1 | | | | |
| NCU08156 | | Other | 2 | | | | |
| NCU08170 | | Other | 5 | | | | |
| NCU08455 | | Mitochondrion | 5 | | | | |
| NCU08554 | | Other | 1 | | | | |
| NCU08622 | | Other | 5 | | | | |
| NCU08700 | | Mitochondrion | 4 | | | | |
| NCU08775 | | Mitochondrion | 4 | 1 | | | |
| NCU09272 | | Other | 2 | | | | |
| NCU09273 | | Mitochondrion | 1 | | | | |
| NCU09274 | | Other | 3 | | | | |
| NCU09335 | | Other | 2 | | | | |
| NCU09342 | | Other | 2 | | | | |
| NCU09714 | | Other | 1 | | | | |
| NCU09782 | | Other | 3 | 4 | | | |
| NCU10062 | | Other | 5 | | | | |
| NCU10301 | | Other | 3 | 1 | | | |
| NCU11565 | | Other | 1 | | | | |
| NCU11774 | | | | | | | |
| NCU11881 | | Other | 5 | | | | |
| NCU11974 | | Other | 2 | | | | |
| NCU11989 | | Other | 2 | | | | |
| NCU12012 | | | | | | | |
| NCU12014 | | Other | 4 | | | | |
| NCU12015 | | Other | 4 | | | | |

CAZy: Predicted Domains from the Carbohydrate Active Enzymes database (Cantarel et al., (2009) Nucleic Acids Res 37: D233-238 [PMID: 18838391]).
SignalP: Predicted target location from Signal P (Bendtsen et al., J. Mol. Biol., 340: 783-795, 2004).
TM Domains: Predicted Transmembrane Domains LCMS: Condition under which a gene product was detected in the culture supernatant by Tian et al., Proc Natl Acad Sci 2009.
Tian et al., MA: Condition under which Tian et al., Proc Natl Acad Sci 2009 detected transcriptional changes by microarray.
Tian et al., Annotation: Classification as cellulase or hemicellulase by Tian et al., Proc Natl Acad Sci 2009.

TABLE 1C

FPKMs identified from profiling data in different mutant strains and growth conditions

| Gene | Sucrose | No Carbon | Cellulose | Δclr-1 | Δclr-2 | Xylan FPKM |
|---|---|---|---|---|---|---|
| NCU00554 | 2050 | 87 | 313 | 116 | 99 | 551 |
| NCU00944 | 283 | 229 | 422 | 161 | 213 | 252 |
| NCU01195 | 15484 | 1792 | 3179 | 982 | 887 | 16026 |
| NCU02785 | 1091 | 62 | 146 | 79 | 78 | 300 |
| NCU02954 | 1862 | 154 | 250 | 131 | 122 | 1000 |
| NCU03131 | 149 | 68 | 236 | 97 | 78 | 184 |
| NCU04216 | 1239 | 8 | 26 | 5 | 5 | 236 |
| NCU04298 | 9 | 105 | 218 | 119 | 140 | 785 |
| NCU04837 | 2537 | 170 | 336 | 157 | 181 | 694 |
| NCU05548 | 2782 | 111 | 581 | 63 | 73 | 563 |
| NCU07413 | 35 | 13 | 106 | 19 | 18 | 95 |
| NCU10283 | 1142 | 121 | 522 | 177 | 154 | 410 |
| NCU00461 | 91 | 4049 | 1099 | 4925 | 2071 | 255 |
| NCU00591 | 22 | 1360 | 458 | 2184 | 1250 | 61 |
| NCU00680 | 555 | 1138 | 327 | 1280 | 888 | 387 |
| NCU01402 | 1 | 203 | 58 | 744 | 687 | 5 |
| NCU02127 | 10 | 662 | 177 | 1585 | 794 | 44 |
| NCU02704 | 14 | 349 | 104 | 1118 | 533 | 15 |
| NCU02727 | 290 | 220 | 141 | 435 | 185 | 183 |
| NCU02936 | 103 | 451 | 151 | 1083 | 527 | 40 |
| NCU03076 | 322 | 746 | 311 | 1571 | 904 | 194 |
| NCU03415 | 43 | 17491 | 4745 | 15467 | 11754 | 2948 |
| NCU03648 | 2 | 1496 | 667 | 2234 | 1969 | 221 |
| NCU03913 | 35 | 349 | 146 | 1194 | 580 | 40 |
| NCU05499 | 11 | 809 | 306 | 2076 | 1535 | 28 |
| NCU05537 | 14 | 465 | 224 | 1257 | 813 | 32 |
| NCU05977 | 11 | 762 | 100 | 486 | 310 | 761 |
| NCU06448 | 944 | 1508 | 978 | 2366 | 1474 | 722 |
| NCU06543 | 151 | 784 | 414 | 1264 | 762 | 166 |

TABLE 1C-continued

FPKMs identified from profiling data in different mutant strains and growth conditions

| Gene | Sucrose | No Carbon | Cellulose | Δclr-1 | Δclr-2 | Xylan FPKM |
|---|---|---|---|---|---|---|
| NCU07153 | 738 | 2886 | 1877 | 6968 | 4284 | 718 |
| NCU08216 | 340 | 187 | 80 | 421 | 251 | 67 |
| NCU09116 | 376 | 206 | 82 | 417 | 229 | 62 |
| NCU09266 | 101 | 1296 | 603 | 2306 | 1479 | 379 |
| NCU09864 | 40 | 1090 | 416 | 2430 | 1372 | 52 |
| NCU11195 | 166 | 677 | 307 | 598 | 450 | 261 |
| NCU01830 | 9 | 645 | 446 | 1362 | 1859 | 11 |
| NCU02126 | 7 | 383 | 117 | 687 | 407 | 40 |
| NCU01744 | 1187 | 197 | 500 | 461 | 264 | 1148 |
| NCU03748 | 5279 | 95 | 245 | 130 | 178 | 1873 |
| NCU06625 | 41 | 400 | 61 | 112 | 113 | 70 |
| NCU04130 | 33 | 155 | 375 | 612 | 304 | 350 |
| NCU10110 | 8 | 56 | 1068 | 615 | 786 | 2096 |
| NCU03861 | 3 | 31 | 5 | 5 | 8 | 0.01 |
| NCU07623 | 1 | 69 | 29 | 30 | 28 | 9 |
| NCU01427 | 170 | 1652 | 490 | 537 | 591 | 196 |
| NCU03651 | 256 | 51 | 979 | 243 | 54 | 809 |
| NCU02579 | 27 | 1820 | 878 | 1457 | 1443 | 181 |
| NCU07307 | 1700 | 148 | 38 | 59 | 53 | 785 |
| NCU07308 | 2206 | 96 | 23 | 42 | 37 | 720 |
| NCU05858 | 3 | 97 | 17 | 16 | 16 | 16 |
| NCU01013 | 260 | 183 | 337 | 177 | 187 | 311 |
| NCU06189 | 468 | 38 | 76 | 42 | 41 | 308 |
| NCU05165 | 100 | 247 | 517 | 87 | 253 | 213 |
| NCU04865 | 22 | 218 | 46 | 72 | 108 | 72 |
| NCU05011 | 12 | 17 | 45 | 37 | 41 | 24 |
| NCU00762 | 11 | 11 | 39334 | 33 | 26 | 292 |
| NCU00836 | 10 | 9 | 9725 | 21 | 11 | 58 |
| NCU01050 | 6 | 0.01 | 27848 | 3 | 0.01 | 9 |
| NCU02240 | 8 | 48 | 19889 | 63 | 50 | 180 |
| NCU02344 | 53 | 16 | 278 | 13 | 9 | 40 |
| NCU02916 | 24 | 33 | 9996 | 39 | 57 | 79 |
| NCU03328 | 7 | 162 | 7020 | 170 | 187 | 47 |
| NCU04854 | 16 | 41 | 2195 | 44 | 46 | 61 |
| NCU05057 | 11 | 31 | 12125 | 38 | 40 | 91 |
| NCU05121 | 8 | 35 | 496 | 25 | 25 | 19 |
| NCU07190 | 39 | 98 | 54230 | 101 | 383 | 1977 |
| NCU07340 | 32 | 118 | 104476 | 170 | 152 | 274 |
| NCU07760 | 28 | 19 | 174 | 32 | 27 | 80 |
| NCU07898 | 3 | 15 | 7268 | 26 | 25 | 59 |
| NCU08760 | 16 | 25 | 24669 | 31 | 19 | 219 |
| NCU09680 | 41 | 99 | 62514 | 130 | 126 | 70 |
| NCU03322 | 1 | 73 | 1360 | 641 | 782 | 1879 |
| NCU07362 | 82 | 541 | 202 | 279 | 259 | 380 |
| NCU03813 | 14 | 589 | 1740 | 1581 | 1072 | 2822 |
| NCU04539 | 2 | 57 | 25 | 22 | 30 | 17 |
| NCU08687 | 110 | 283 | 1342 | 431 | 354 | 1147 |
| NCU05133 | 957 | 320 | 1831 | 1241 | 1520 | 1247 |
| NCU09705 | 44 | 266 | 4525 | 2740 | 3468 | 11549 |
| NCU07277 | 682 | 1273 | 3013 | 3216 | 3317 | 2258 |
| NCU04797 | 30 | 877 | 258 | 1646 | 542 | 167 |
| NCU00575 | 2198 | 677 | 2103 | 1123 | 1057 | 1812 |
| NCU04401 | 8 | 66 | 3833 | 1630 | 2316 | 7742 |
| NCU02855 | 5 | 11 | 4659 | 63 | 36 | 385 |
| NCU05924 | 5 | 5 | 19425 | 14 | 4 | 2339 |
| NCU05955 | 14 | 100 | 4569 | 88 | 102 | 64 |
| NCU07326 | 18 | 55 | 10461 | 63 | 43 | 110 |
| NCU09775 | 0.01 | 3 | 99 | 10 | 6 | 302 |
| NCU04997 | 5 | 3 | 116 | 16 | 8 | 20 |
| NCU01900 | 28 | 210 | 11254 | 6388 | 7907 | 14560 |
| NCU02343 | 41 | 458 | 9436 | 14639 | 15125 | 23514 |
| NCU07225 | 35 | 111 | 104230 | 7967 | 5971 | 24494 |
| NCU08087 | 72 | 4 | 35 | 83 | 63 | 129 |
| NCU08189 | 27 | 208 | 42393 | 39471 | 48947 | 50079 |
| NCU09652 | 24 | 340 | 4032 | 3208 | 3390 | 5729 |
| NCU06881 | 249 | 259 | 169 | 421 | 251 | 125 |
| NCU01853 | 0.01 | 123 | 50 | 131 | 131 | 25 |
| NCU02287 | 134 | 703 | 406 | 1073 | 886 | 94 |
| NCU02894 | 107 | 191 | 83 | 140 | 126 | 113 |
| NCU07263 | 166 | 197 | 68 | 278 | 129 | 24 |
| NCU08924 | 132 | 2324 | 770 | 1742 | 1287 | 205 |
| NCU09692 | 24 | 383 | 124 | 330 | 267 | 71 |
| NCU04796 | 166 | 1919 | 704 | 1594 | 1469 | 135 |
| NCU09732 | 112 | 772 | 430 | 1876 | 740 | 222 |

TABLE 1C-continued

FPKMs identified from profiling data in different mutant strains and growth conditions

| Gene | Sucrose | No Carbon | Cellulose | Δclr-1 | Δclr-2 | Xylan FPKM |
|---|---|---|---|---|---|---|
| NCU07719 | 865 | 941 | 441 | 572 | 562 | 616 |
| NCU12093 | 14 | 279 | 74 | 156 | 136 | 23 |
| NCU05818 | 2 | 29 | 10 | 5 | 5 | 4 |
| NCU04078 | 15 | 360 | 117 | 643 | 316 | 48 |
| NCU07617 | 9 | 196 | 37 | 41 | 49 | 7 |
| NCU08398 | 2 | 52 | 5368 | 66 | 25 | 84 |
| NCU10683 | 12 | 37 | 99 | 36 | 32 | 41 |
| NCU10063 | 45 | 256 | 68 | 112 | 107 | 150 |
| NCU04933 | 35 | 27 | 155 | 249 | 248 | 100 |
| NCU00890 | 18 | 63 | 1613 | 139 | 58 | 536 |
| NCU04623 | 3 | 40 | 128 | 38 | 69 | 161 |
| NCU04952 | 1 | 62 | 777 | 22 | 32 | 17 |
| NCU05956 | 5 | 398 | 935 | 379 | 446 | 134 |
| NCU07487 | 2 | 6 | 988 | 6 | 13 | 5 |
| NCU08755 | 6 | 468 | 8742 | 467 | 3396 | 2802 |
| NCU00130 | 30 | 159 | 39866 | 759 | 2765 | 1736 |
| NCU00709 | 2 | 6 | 192 | 300 | 311 | 2803 |
| NCU04168 | 4 | 18 | 166 | 407 | 302 | 40 |
| NCU09904 | 13 | 16 | 76 | 111 | 98 | 198 |
| NCU09923 | 1 | 12 | 222 | 92 | 89 | 2701 |
| NCU03098 | 1 | 360 | 56 | 75 | 107 | 17 |
| NCU09028 | 0.01 | 26 | 8 | 7 | 9 | 6 |
| NCU09281 | 16 | 704 | 133 | 171 | 180 | 23 |
| NCU10107 | 0.01 | 165 | 2709 | 1434 | 2108 | 3537 |
| NCU00206 | 12 | 24 | 12252 | 18 | 23 | 16 |
| NCU00710 | 11 | 11 | 921 | 43 | 44 | 174 |
| NCU01059 | 37 | 42 | 253 | 26 | 91 | 39 |
| NCU03181 | 5 | 32 | 2023 | 39 | 21 | 49 |
| NCU04494 | 87 | 74 | 529 | 65 | 75 | 143 |
| NCU05598 | 39 | 26 | 313 | 39 | 36 | 144 |
| NCU05751 | 4 | 10 | 1138 | 5 | 9 | 1422 |
| NCU08176 | 6 | 18 | 1547 | 35 | 24 | 268 |
| NCU08746 | 3 | 44 | 289 | 22 | 55 | 639 |
| NCU08785 | 1 | 26 | 5257 | 3 | 3 | 126 |
| NCU09445 | 1 | 0.01 | 28 | 0.01 | 2 | 5 |
| NCU09491 | 0.01 | 19 | 508 | 21 | 15 | 172 |
| NCU09582 | 9 | 17 | 2971 | 54 | 60 | 759 |
| NCU09764 | 28 | 9 | 2438 | 14 | 15 | 29 |
| NCU09774 | 0.01 | 0.01 | 18 | 0.01 | 0.01 | 0.01 |
| NCU09976 | 3 | 4 | 77 | 3 | 6 | 20 |
| NCU10045 | 18 | 71 | 1641 | 213 | 206 | 1324 |
| NCU11068 | 6 | 71 | 12618 | 670 | 6 | 1972 |
| NCU11198 | 36 | 40 | 742 | 47 | 49 | 971 |
| NCU02904 | 109 | 40 | 115 | 65 | 54 | 147 |
| NCU04870 | 2 | 6 | 7059 | 218 | 261 | 3933 |
| NCU05159 | 13 | 91 | 27383 | 1840 | 1333 | 7683 |
| NCU09518 | 8 | 32 | 107 | 52 | 54 | 17 |
| NCU09664 | 0.01 | 0.01 | 1039 | 4 | 4 | 130 |
| NCU09924 | 2 | 19 | 112 | 43 | 45 | 2511 |
| NCU03158 | 122 | 211 | 86 | 108 | 120 | 64 |
| NCU07067 | 5 | 1242 | 225 | 426 | 368 | 121 |
| NCU01353 | 1106 | 104 | 483 | 281 | 328 | 628 |
| NCU07269 | 1 | 179 | 57 | 43 | 45 | 8 |
| NCU06023 | 17 | 54 | 21 | 28 | 27 | 19 |
| NCU06025 | 32 | 68 | 26 | 27 | 27 | 24 |
| NCU00761 | 0.01 | 3 | 25 | 3 | 4 | 0.01 |
| NCU06650 | 90 | 902 | 473 | 238 | 128 | 1654 |
| NCU09416 | 0.01 | 0.01 | 1614 | 4 | 4 | 106 |
| NCU00292 | 7 | 64 | 2892 | 2788 | 3721 | 4938 |
| NCU03903 | 32 | 97 | 392 | 236 | 241 | 203 |
| NCU04475 | 22 | 231 | 4395 | 2771 | 1833 | 2387 |
| NCU06364 | 202 | 108 | 812 | 370 | 586 | 1635 |
| NCU09575 | 20 | 632 | 228 | 245 | 222 | 95 |
| NCU04230 | 250 | 1891 | 185 | 1237 | 538 | 80 |
| NCU02366 | 3209 | 11379 | 4010 | 5034 | 5173 | 3702 |
| NCU04280 | 1323 | 271 | 70 | 99 | 107 | 394 |
| NCU04385 | 1604 | 43 | 14 | 18 | 18 | 1035 |
| NCU02969 | 81 | 45 | 10 | 12 | 14 | 34 |
| NCU08164 | 89 | 193 | 685 | 340 | 367 | 765 |
| NCU00891 | 98 | 330 | 6350 | 7725 | 8502 | 22723 |
| NCU08384 | 56 | 72 | 22043 | 28279 | 28261 | 76835 |
| NCU08272 | 141 | 380 | 170 | 424 | 261 | 315 |
| NCU07619 | 8 | 31 | 14 | 19 | 20 | 10 |
| NCU05304 | 2192 | 188 | 412 | 175 | 219 | 837 |

TABLE 1C-continued

FPKMs identified from profiling data in different mutant strains and growth conditions

| Gene | Sucrose | No Carbon | Cellulose | Δclr-1 | Δclr-2 | Xylan FPKM |
|---|---|---|---|---|---|---|
| NCU01510 | 15 | 772 | 319 | 623 | 681 | 124 |
| NCU05768 | 6 | 39 | 0.01 | 2 | 0.01 | 0.01 |
| NCU07154 | 12 | 158 | 65 | 101 | 93 | 23 |
| NCU01998 | 241 | 46 | 107 | 96 | 84 | 246 |
| NCU08457 | 200 | 210102 | 18274 | 13320 | 20799 | 1223 |
| NCU06386 | 87 | 127 | 300 | 160 | 155 | 175 |
| NCU09425 | 40 | 740 | 3087 | 1228 | 1964 | 538 |
| NCU02478 | 152 | 16 | 57 | 32 | 39 | 39 |
| NCU09175 | 2497 | 5190 | 10237 | 7817 | 8879 | 6804 |
| NCU01689 | 1517 | 418 | 558 | 256 | 402 | 1214 |
| NCU11721 | 233 | 209 | 367 | 173 | 156 | 242 |
| NCU02396 | 131 | 66 | 27 | 59 | 33 | 24 |
| NCU07481 | 76 | 25 | 62 | 43 | 46 | 121 |
| NCU03137 | 271 | 112 | 308 | 146 | 138 | 153 |
| NCU02500 | 29 | 1042 | 2415 | 0.01 | 0.01 | 732 |
| NCU00565 | 498 | 254 | 92 | 217 | 155 | 206 |
| NCU02705 | 245 | 54 | 26 | 117 | 61 | 37 |
| NCU05225 | 57 | 312 | 115 | 176 | 161 | 170 |
| NCU08326 | 204 | 119 | 62 | 220 | 91 | 73 |
| NCU00326 | 465 | 430 | 1721 | 260 | 639 | 916 |
| NCU08691 | 3 | 47 | 13 | 15 | 12 | 6 |
| NCU09043 | 30 | 3328 | 1226 | 1683 | 1701 | 602 |
| NCU07432 | 170 | 180 | 544 | 326 | 270 | 95 |
| NCU05841 | 356 | 46 | 484 | 149 | 126 | 441 |
| NCU02361 | 146 | 204 | 119 | 359 | 203 | 747 |
| NCU10051 | 2833 | 301 | 12598 | 4676 | 1474 | 2773 |
| NCU04720 | 1382 | 231 | 1993 | 748 | 1018 | 2367 |
| NCU04698 | 349 | 178 | 419 | 238 | 318 | 176 |
| NCU00177 | 2560 | 43 | 100 | 35 | 40 | 710 |
| NCU01786 | 1012 | 45 | 117 | 32 | 53 | 560 |
| NCU03117 | 6482 | 42 | 201 | 21 | 20 | 1298 |
| NCU05254 | 229 | 17 | 33 | 11 | 16 | 106 |
| NCU03963 | 1528 | 15 | 172 | 6 | 23 | 514 |
| NCU09659 | 685 | 134 | 70 | 472 | 193 | 640 |
| NCU03488 | 1689 | 1939 | 508 | 917 | 875 | 1054 |
| NCU02657 | 11661 | 70 | 205 | 80 | 83 | 1464 |
| NCU05855 | 13 | 20 | 315 | 42 | 49 | 41 |
| NCU08044 | 385 | 420 | 1387 | 710 | 381 | 566 |
| NCU09283 | 83 | 337 | 812 | 244 | 319 | 267 |
| NCU11243 | 2 | 190 | 406 | 123 | 116 | 43 |
| NCU01378 | 88 | 574 | 235 | 436 | 374 | 186 |
| NCU01861 | 0.01 | 394 | 138 | 717 | 593 | 497 |
| NCU04583 | 237 | 103 | 47 | 381 | 409 | 42 |
| NCU06616 | 19 | 636 | 149 | 853 | 329 | 45 |
| NCU07325 | 3 | 1419 | 487 | 922 | 1047 | 177 |
| NCU08771 | 28 | 3639 | 1648 | 5213 | 3274 | 485 |
| NCU09553 | 201 | 574 | 217 | 918 | 509 | 74 |
| NCU10055 | 3 | 812 | 330 | 851 | 856 | 321 |
| NCU11289 | 2 | 26 | 5 | 14 | 17 | 0.01 |
| NCU08750 | 33 | 213 | 1249 | 466 | 690 | 518 |
| NCU08752 | 6 | 146 | 2469 | 450 | 1299 | 5930 |
| NCU03049 | 5 | 106 | 43 | 58 | 55 | 35 |
| NCU05653 | 49 | 62 | 21 | 39 | 27 | 16 |
| NCU07133 | 12 | 1196 | 443 | 713 | 603 | 441 |
| NCU08925 | 38 | 135 | 51 | 78 | 69 | 28 |
| NCU09865 | 3 | 21 | 8 | 12 | 11 | 0.01 |
| NCU11365 | 62 | 96 | 44 | 73 | 48 | 39 |
| NCU07055 | 0.01 | 16 | 191 | 75 | 88 | 212 |
| NCU07224 | 0.01 | 0.01 | 203 | 22 | 19 | 170 |
| NCU01061 | 47 | 194 | 35 | 39 | 34 | 8 |
| NCU03566 | 30 | 164 | 72 | 71 | 82 | 78 |
| NCU04260 | 28 | 396 | 172 | 143 | 166 | 74 |
| NCU05094 | 7 | 379 | 101 | 125 | 142 | 40 |
| NCU05986 | 86 | 230 | 128 | 120 | 124 | 76 |
| NCU06153 | 0.01 | 634 | 350 | 196 | 213 | 128 |
| NCU09674 | 209 | 1068 | 454 | 452 | 424 | 601 |
| NCU11241 | 265 | 492 | 158 | 225 | 194 | 128 |
| NCU03013 | 452 | 1461 | 3723 | 3169 | 3589 | 4288 |
| NCU05319 | 39 | 5 | 25 | 12 | 10 | 19 |
| NCU04430 | 7 | 71 | 102 | 1738 | 599 | 45 |
| NCU02059 | 520 | 83 | 1010 | 171 | 121 | 257 |
| NCU00831 | 162 | 796 | 532 | 1450 | 897 | 559 |
| NCU06055 | 161 | 151 | 347 | 273 | 246 | 233 |
| NCU00263 | 55 | 118 | 158 | 670 | 324 | 191 |

TABLE 1C-continued

FPKMs identified from profiling data in different mutant strains and growth conditions

| Gene | Sucrose | No Carbon | Cellulose | Δclr-1 | Δclr-2 | Xylan FPKM |
|---|---|---|---|---|---|---|
| NCU07200 | 215 | 477 | 667 | 4484 | 1939 | 312 |
| NCU09992 | 25 | 177 | 420 | 3258 | 1302 | 143 |
| NCU09265 | 1614 | 952 | 5131 | 1413 | 1691 | 2611 |
| NCU00813 | 165 | 590 | 1841 | 555 | 639 | 598 |
| NCU02455 | 1925 | 1985 | 5593 | 2466 | 2663 | 3092 |
| NCU09223 | 1323 | 1972 | 8850 | 2804 | 2900 | 2955 |
| NCU09485 | 444 | 248 | 940 | 299 | 324 | 489 |
| NCU01648 | 838 | 418 | 1306 | 631 | 599 | 1003 |
| NCU10497 | 738 | 602 | 1111 | 624 | 720 | 856 |
| NCU00669 | 494 | 336 | 735 | 331 | 389 | 575 |
| NCU02118 | 66 | 74 | 45 | 62 | 59 | 28 |
| NCU10762 | 149 | 47 | 123 | 80 | 67 | 161 |
| NCU00244 | 126 | 117 | 59 | 56 | 60 | 58 |
| NCU01068 | 135 | 371 | 1235 | 552 | 519 | 988 |
| NCU03319 | 940 | 1076 | 2513 | 1218 | 1267 | 1413 |
| NCU08761 | 137 | 117 | 269 | 113 | 132 | 184 |
| NCU01279 | 355 | 489 | 165 | 311 | 352 | 91 |
| NCU03819 | 117 | 109 | 252 | 148 | 160 | 133 |
| NCU08607 | 278 | 312 | 764 | 444 | 394 | 465 |
| NCU09195 | 151 | 453 | 168 | 260 | 285 | 126 |
| NCU07736 | 42 | 17 | 131 | 451 | 277 | 297 |
| NCU01290 | 2430 | 43 | 74 | 20 | 29 | 681 |
| NCU03396 | 2598 | 26 | 54 | 10 | 16 | 524 |
| NCU09521 | 618 | 12 | 28 | 6 | 9 | 173 |
| NCU03897 | 1005 | 305 | 611 | 239 | 291 | 569 |
| NCU07746 | 448 | 249 | 969 | 303 | 300 | 424 |
| NCU08897 | 1372 | 727 | 2550 | 971 | 1068 | 1948 |
| NCU00169 | 486 | 315 | 1214 | 404 | 395 | 655 |
| NCU02681 | 691 | 372 | 1150 | 435 | 391 | 519 |
| NCU06333 | 488 | 307 | 1502 | 340 | 339 | 589 |
| NCU01146 | 1459 | 761 | 1819 | 1168 | 1149 | 1489 |
| NCU00931 | 308 | 6 | 18 | 7 | 9 | 98 |
| NCU07008 | 47 | 226 | 107 | 103 | 99 | 130 |
| NCU03295 | 13 | 200 | 125 | 322 | 211 | 42 |
| NCU07737 | 62 | 113 | 881 | 2349 | 1712 | 516 |
| NCU08038 | 15 | 85 | 261 | 125 | 146 | 69 |
| NCU02729 | 621 | 4 | 16 | 3 | 4 | 111 |
| NCU03364 | 209 | 744 | 1586 | 596 | 647 | 654 |
| NCU03817 | 66 | 135 | 46 | 62 | 62 | 58 |
| NCU06111 | 350 | 164 | 87 | 70 | 57 | 172 |
| NCU08115 | 47 | 48 | 396 | 97 | 185 | 82 |
| NCU06931 | 9 | 48 | 33 | 75 | 53 | 14 |
| NCU04077 | 1661 | 38 | 212 | 71 | 83 | 1471 |
| NCU01862 | 10 | 369 | 103 | 229 | 239 | 31 |
| NCU02795 | 61 | 24 | 53 | 47 | 52 | 64 |
| NCU00812 | 459 | 103 | 208 | 88 | 131 | 217 |
| NCU01856 | 850 | 504 | 2100 | 752 | 727 | 711 |
| NCU03725 | 437 | 184 | 1312 | 322 | 317 | 701 |
| NCU06971 | 10 | 336 | 1103 | 330 | 475 | 271 |
| NCU07705 | 39 | 173 | 751 | 11 | 510 | 417 |
| NCU08042 | 3 | 9 | 1262 | 15 | 0.01 | 16 |
| NCU03643 | 21 | 198 | 57 | 246 | 163 | 24 |
| NCU03043 | 147 | 1202 | 276 | 657 | 544 | 429 |
| NCU05767 | 0.01 | 263 | 18 | 26 | 33 | 0.01 |
| NCU00316 | 124 | 249 | 122 | 366 | 199 | 128 |
| NCU00721 | 98 | 279 | 152 | 873 | 742 | 147 |
| NCU07578 | 10 | 41 | 34 | 65 | 50 | 8 |
| NCU04435 | 6 | 18 | 3 | 5 | 6 | 25 |
| NCU05198 | 171 | 136 | 54 | 87 | 91 | 99 |
| NCU10721 | 100 | 116 | 398 | 137 | 129 | 242 |
| NCU11342 | 1 | 19 | 118 | 33 | 37 | 8 |
| NCU00821 | 492 | 1869 | 1080 | 3808 | 2577 | 1577 |
| NCU08561 | 24 | 410 | 62 | 316 | 152 | 28 |
| NCU09287 | 8 | 3578 | 2172 | 6710 | 5148 | 1987 |
| NCU00801 | 29 | 262 | 17161 | 861 | 1533 | 340 |
| NCU00809 | 43 | 85 | 194 | 163 | 131 | 499 |
| NCU07668 | 33 | 38 | 159 | 86 | 81 | 28 |
| NCU05089 | 38 | 72 | 9 | 21 | 19 | 14 |
| NCU08152 | 0.01 | 159 | 22 | 64 | 53 | 0.01 |
| NCU01633 | 3273 | 118 | 394 | 1728 | 1321 | 36 |
| NCU04537 | 12 | 15 | 35 | 118 | 84 | 339 |
| NCU05853 | 17 | 1550 | 19630 | 5956 | 16364 | 2012 |
| NCU08114 | 25 | 508 | 45944 | 13300 | 29186 | 11873 |
| NCU00023 | 459 | 594 | 1250 | 411 | 450 | 554 |

TABLE 1C-continued

FPKMs identified from profiling data in different mutant strains and growth conditions

| Gene | Sucrose | No Carbon | Cellulose | Δclr-1 | Δclr-2 | Xylan FPKM |
|---|---|---|---|---|---|---|
| NCU02009 | 295 | 443 | 4284 | 707 | 715 | 542 |
| NCU07068 | 7 | 2473 | 873 | 1574 | 1697 | 233 |
| NCU03305 | 583 | 367 | 672 | 475 | 434 | 701 |
| NCU08225 | 707 | 168 | 73 | 106 | 104 | 718 |
| NCU08147 | 113 | 3406 | 1284 | 2158 | 2101 | 814 |
| NCU06366 | 338 | 451 | 202 | 213 | 235 | 215 |
| NCU05585 | 10 | 1426 | 433 | 802 | 647 | 307 |
| NCU06138 | 11 | 167 | 3757 | 2567 | 2713 | 5610 |
| NCU05591 | 59 | 94 | 312 | 270 | 403 | 105 |
| NCU06032 | 84 | 137 | 334 | 117 | 120 | 135 |
| NCU09098 | 40 | 72 | 196 | 60 | 69 | 57 |
| NCU10009 | 103 | 37 | 84 | 42 | 51 | 102 |
| NCU00290 | 2 | 172 | 38 | 140 | 78 | 31 |
| NCU09580 | 7 | 40 | 12 | 45 | 31 | 14 |
| NCU00803 | 22 | 157 | 57 | 77 | 76 | 17 |
| NCU04374 | 16 | 195 | 37 | 62 | 67 | 49 |
| NCU08425 | 14 | 364 | 41 | 105 | 88 | 10 |
| NCU04097 | 1105 | 99 | 95 | 151 | 99 | 83 |
| NCU05079 | 364 | 981 | 1440 | 6283 | 3699 | 226 |
| NCU07546 | 89 | 70 | 231 | 157 | 189 | 87 |
| NCU08148 | 738 | 193 | 420 | 1416 | 611 | 472 |
| NCU03107 | 109 | 354 | 95 | 75 | 82 | 43 |
| NCU00586 | 17 | 547 | 97 | 400 | 333 | 11 |
| NCU00716 | 15 | 167 | 49 | 228 | 62 | 0.01 |
| NCU00025 | 166 | 1481 | 553 | 924 | 881 | 246 |
| NCU00848 | 41 | 261 | 9 | 11 | 7 | 23 |
| NCU00449 | 3 | 7 | 1235 | 8 | 12 | 36 |
| NCU00849 | 4 | 66 | 9 | 6 | 0.01 | 0.01 |
| NCU01058 | 6 | 14 | 73 | 12 | 30 | 0.01 |
| NCU01076 | 0.01 | 3 | 784 | 0.01 | 0.01 | 0.01 |
| NCU01196 | 60 | 55 | 88 | 41 | 30 | 127 |
| NCU01978 | 15 | 21 | 47 | 17 | 24 | 21 |
| NCU02138 | 113 | 158 | 462 | 69 | 59 | 55 |
| NCU03083 | 677 | 273 | 890 | 355 | 347 | 593 |
| NCU03982 | 2821 | 1679 | 13085 | 3300 | 3442 | 5011 |
| NCU04948 | 1 | 2 | 18 | 3 | 5 | 0.01 |
| NCU05230 | 101 | 23 | 84 | 24 | 27 | 67 |
| NCU05863 | 0.01 | 21 | 563 | 12 | 69 | 0.01 |
| NCU05864 | 23 | 64 | 14268 | 143 | 96 | 212 |
| NCU06152 | 4 | 45 | 76 | 23 | 35 | 37 |
| NCU06607 | 35 | 21 | 794 | 31 | 26 | 20 |
| NCU08756 | 4 | 10 | 120 | 10 | 46 | 28 |
| NCU08790 | 1 | 10 | 389 | 16 | 44 | 103 |
| NCU09295 | 321 | 86 | 292 | 115 | 131 | 348 |
| NCU09524 | 3 | 14 | 2814 | 29 | 10 | 11 |
| NCU11268 | 26 | 140 | 471 | 125 | 149 | 41 |
| NCU11542 | 10 | 76 | 261 | 84 | 78 | 31 |
| NCU11753 | 32 | 37 | 163 | 21 | 20 | 532 |
| NCU00175 | 13 | 1227 | 188 | 932 | 575 | 83 |
| NCU00250 | 9 | 234 | 67 | 187 | 144 | 0.01 |
| NCU00322 | 174 | 566 | 235 | 882 | 592 | 55 |
| NCU00695 | 55 | 1158 | 939 | 2708 | 2217 | 485 |
| NCU07311 | 144 | 4941 | 1286 | 3903 | 3941 | 1195 |
| NCU08171 | 509 | 1381 | 376 | 852 | 648 | 1136 |
| NCU08521 | 0.01 | 20 | 9 | 14 | 15 | 0.01 |
| NCU10507 | 3 | 251 | 91 | 182 | 143 | 58 |
| NCU07143 | 11 | 86 | 13931 | 645 | 526 | 3583 |
| NCU07222 | 48 | 2 | 147 | 42 | 22 | 114 |
| NCU08371 | 54 | 176 | 706 | 379 | 347 | 148 |
| NCU09506 | 369 | 2 | 50 | 13 | 6 | 17 |
| NCU04106 | 388 | 319 | 61 | 107 | 98 | 155 |
| NCU06526 | 7 | 708 | 145 | 222 | 346 | 35 |
| NCU09196 | 4 | 94 | 42 | 51 | 60 | 10 |
| NCU11466 | 2 | 221 | 92 | 133 | 152 | 14 |
| NCU11957 | 0.01 | 19 | 7 | 14 | 7 | 0.01 |
| NCU00995 | 2433 | 398 | 1114 | 3520 | 1448 | 924 |
| NCU01720 | 931 | 61 | 178 | 270 | 226 | 760 |
| NCU03293 | 12057 | 118 | 359 | 844 | 656 | 5218 |
| NCU04169 | 3 | 20 | 2545 | 5669 | 5833 | 803 |
| NCU04170 | 11 | 35 | 203 | 466 | 412 | 40 |
| NCU04467 | 63 | 56 | 320 | 323 | 235 | 71 |
| NCU04932 | 197 | 136 | 873 | 1493 | 1451 | 1072 |
| NCU04998 | 5 | 5 | 27 | 22 | 18 | 0.01 |
| NCU05134 | 653 | 65 | 1366 | 826 | 1673 | 2090 |

TABLE 1C-continued

FPKMs identified from profiling data in different mutant strains and growth conditions

| Gene | Sucrose | No Carbon | Cellulose | Δclr-1 | Δclr-2 | Xylan FPKM |
|---|---|---|---|---|---|---|
| NCU05350 | 1 | 37 | 315 | 191 | 286 | 447 |
| NCU05829 | 294 | 22 | 65 | 55 | 45 | 139 |
| NCU05852 | 4 | 67 | 200 | 161 | 219 | 35 |
| NCU05908 | 7 | 20 | 44 | 67 | 27 | 138 |
| NCU06143 | 16 | 147 | 3784 | 3215 | 3870 | 7304 |
| NCU06983 | 564 | 103 | 620 | 1152 | 1130 | 1537 |
| NCU06991 | 97 | 22 | 99 | 97 | 125 | 246 |
| NCU08635 | 0.01 | 29 | 61 | 101 | 83 | 0.01 |
| NCU09046 | 0.01 | 6 | 22 | 54 | 36 | 8 |
| NCU09172 | 0.01 | 0.01 | 9 | 1 | 1 | 0.01 |
| NCU09424 | 1 | 13 | 49 | 34 | 36 | 20 |
| NCU09498 | 340 | 67 | 252 | 430 | 417 | 790 |
| NCU09823 | 28 | 101 | 350 | 697 | 526 | 333 |
| NCU09848 | 215 | 15 | 76 | 53 | 51 | 32 |
| NCU10014 | 419 | 93 | 997 | 1874 | 1669 | 1536 |
| NCU10039 | 8 | 56 | 888 | 376 | 441 | 167 |
| NCU10687 | 258 | 62 | 165 | 219 | 241 | 958 |
| NCU00561 | 23 | 601 | 165 | 233 | 249 | 67 |
| NCU00859 | 53 | 1441 | 184 | 112 | 162 | 50 |
| NCU02042 | 70 | 164 | 98 | 40 | 51 | 106 |
| NCU02164 | 75 | 909 | 287 | 346 | 343 | 105 |
| NCU04482 | 7 | 70 | 9 | 19 | 10 | 42 |
| NCU04486 | 18 | 449 | 157 | 152 | 193 | 58 |
| NCU05236 | 7 | 386 | 120 | 147 | 141 | 77 |
| NCU05761 | 0.01 | 16 | 0.01 | 0.01 | 0.01 | 0.01 |
| NCU05763 | 0.01 | 18 | 0.01 | 0.01 | 0.01 | 0.01 |
| NCU06328 | 63 | 517 | 97 | 45 | 48 | 124 |
| NCU07948 | 11 | 206 | 28 | 33 | 41 | 28 |
| NCU08140 | 0.01 | 5 | 0.01 | 0.01 | 0.01 | 0.01 |
| NCU08447 | 7 | 144 | 39 | 44 | 40 | 16 |
| NCU09734 | 13 | 653 | 25 | 43 | 53 | 24 |
| NCU12011 | 0.01 | 30 | 2 | 3 | 4 | 0.01 |
| NCU00408 | 245 | 33 | 79 | 19 | 26 | 73 |
| NCU00633 | 464 | 87 | 244 | 67 | 116 | 141 |
| NCU00870 | 58 | 103 | 7992 | 289 | 210 | 1281 |
| NCU00871 | 0.01 | 3 | 19 | 3 | 3 | 0.01 |
| NCU00965 | 410 | 321 | 1037 | 362 | 347 | 506 |
| NCU01003 | 17 | 9 | 50 | 13 | 10 | 22 |
| NCU01049 | 0.01 | 0.01 | 59 | 0.01 | 0.01 | 0.01 |
| NCU01077 | 2 | 10 | 48 | 9 | 10 | 0.01 |
| NCU01148 | 28 | 27 | 106 | 37 | 36 | 36 |
| NCU01944 | 58 | 20 | 441 | 46 | 47 | 43 |
| NCU01970 | 96 | 1490 | 2320 | 719 | 761 | 1015 |
| NCU01983 | 1113 | 36 | 184 | 35 | 43 | 171 |
| NCU02008 | 90 | 108 | 235 | 61 | 65 | 100 |
| NCU02061 | 24 | 17 | 66 | 0.01 | 2 | 39 |
| NCU02600 | 3 | 8 | 26 | 8 | 9 | 0.01 |
| NCU02625 | 21 | 45 | 150 | 44 | 45 | 21 |
| NCU02720 | 419 | 27 | 79 | 21 | 28 | 106 |
| NCU02915 | 34 | 77 | 818 | 153 | 142 | 74 |
| NCU03152 | 317 | 89 | 325 | 103 | 95 | 180 |
| NCU03329 | 91 | 170 | 1134 | 326 | 293 | 135 |
| NCU03433 | 17 | 8 | 39 | 10 | 10 | 18 |
| NCU04127 | 2828 | 968 | 3165 | 993 | 1099 | 1600 |
| NCU04522 | 6 | 16 | 2283 | 22 | 102 | 45 |
| NCU04830 | 532 | 66 | 381 | 109 | 80 | 292 |
| NCU04905 | 347 | 354 | 1506 | 542 | 464 | 924 |
| NCU05056 | 0.01 | 0.01 | 35 | 0.01 | 0.01 | 0.01 |
| NCU05170 | 318 | 205 | 652 | 343 | 208 | 463 |
| NCU05569 | 128 | 74 | 147 | 37 | 42 | 61 |
| NCU05574 | 22 | 59 | 699 | 46 | 156 | 328 |
| NCU05846 | 43 | 120 | 3033 | 165 | 521 | 251 |
| NCU05848 | 1 | 0.01 | 24 | 0.01 | 3 | 0.01 |
| NCU05854 | 12 | 49 | 227 | 59 | 67 | 33 |
| NCU06214 | 1375 | 143 | 262 | 90 | 107 | 327 |
| NCU06312 | 5 | 34 | 62 | 17 | 27 | 12 |
| NCU06704 | 981 | 347 | 1914 | 362 | 466 | 544 |
| NCU07207 | 0.01 | 18 | 44 | 7 | 9 | 0.01 |
| NCU07336 | 39 | 15 | 119 | 20 | 21 | 22 |
| NCU07339 | 0.01 | 10 | 204 | 14 | 9 | 0.01 |
| NCU07453 | 53 | 204 | 868 | 205 | 186 | 1016 |
| NCU07897 | 6 | 16 | 123 | 22 | 20 | 12 |
| NCU07979 | 7 | 31 | 196 | 42 | 48 | 17 |
| NCU08043 | 0.01 | 13 | 42 | 8 | 5 | 0.01 |

TABLE 1C-continued

FPKMs identified from profiling data in different mutant strains and growth conditions

| Gene | Sucrose | No Carbon | Cellulose | Δclr-1 | Δclr-2 | Xylan FPKM |
|---|---|---|---|---|---|---|
| NCU08113 | 4 | 4 | 266 | 7 | 32 | 50 |
| NCU08117 | 75 | 35 | 174 | 35 | 56 | 82 |
| NCU08379 | 1330 | 786 | 2359 | 903 | 1094 | 1579 |
| NCU08624 | 11 | 26 | 342 | 35 | 31 | 14 |
| NCU08784 | 8 | 61 | 303 | 48 | 63 | 32 |
| NCU09003 | 201 | 69 | 133 | 75 | 90 | 180 |
| NCU09426 | 0.01 | 29 | 103 | 35 | 50 | 6 |
| NCU09479 | 11 | 21 | 38 | 21 | 19 | 12 |
| NCU09522 | 87 | 46 | 203 | 54 | 51 | 55 |
| NCU09523 | 26 | 27 | 207 | 51 | 34 | 11 |
| NCU09689 | 8 | 105 | 5646 | 112 | 1811 | 1256 |
| NCU10521 | 63 | 103 | 462 | 88 | 108 | 417 |
| NCU11118 | 468 | 125 | 522 | 103 | 150 | 123 |
| NCU11278 | 8 | 65 | 612 | 51 | 49 | 54 |
| NCU11327 | 531 | 538 | 995 | 523 | 510 | 748 |
| NCU11397 | 3483 | 48 | 161 | 56 | 59 | 648 |
| NCU11690 | 26 | 60 | 158 | 46 | 54 | 27 |
| NCU11722 | 471 | 224 | 571 | 251 | 200 | 327 |
| NCU11862 | 13 | 96 | 273 | 69 | 66 | 52 |
| NCU00247 | 27 | 149 | 82 | 225 | 136 | 74 |
| NCU01347 | 98 | 168 | 116 | 220 | 143 | 38 |
| NCU01598 | 4 | 54 | 17 | 40 | 27 | 0.01 |
| NCU03761 | 105 | 144 | 53 | 210 | 77 | 27 |
| NCU04635 | 109 | 863 | 439 | 1494 | 713 | 76 |
| NCU04667 | 9 | 234 | 101 | 338 | 293 | 23 |
| NCU05058 | 5 | 7 | 0.01 | 9 | 7 | 0.01 |
| NCU05128 | 6 | 89 | 50 | 267 | 221 | 18 |
| NCU06265 | 49 | 3080 | 1086 | 2116 | 2448 | 689 |
| NCU06615 | 125 | 1123 | 359 | 1086 | 594 | 209 |
| NCU06895 | 1 | 2463 | 677 | 5512 | 4070 | 38 |
| NCU07233 | 23 | 153 | 120 | 271 | 172 | 38 |
| NCU07423 | 113 | 92 | 53 | 124 | 77 | 41 |
| NCU07424 | 12 | 190 | 94 | 169 | 127 | 32 |
| NCU07895 | 105 | 920 | 343 | 1438 | 853 | 84 |
| NCU08418 | 69 | 561 | 277 | 927 | 642 | 332 |
| NCU08557 | 0.01 | 41 | 12 | 27 | 26 | 22 |
| NCU08712 | 30 | 52 | 21 | 58 | 35 | 18 |
| NCU09060 | 0.01 | 8 | 0.01 | 5 | 0.01 | 0.01 |
| NCU09231 | 17 | 117 | 92 | 163 | 164 | 10 |
| NCU09685 | 0.01 | 60 | 25 | 69 | 31 | 0.01 |
| NCU09958 | 58 | 489 | 205 | 986 | 474 | 47 |
| NCU10276 | 480 | 621 | 390 | 3406 | 2011 | 359 |
| NCU11697 | 34 | 157 | 89 | 231 | 154 | 39 |
| NCU11944 | 23 | 112 | 58 | 104 | 106 | 0.01 |
| NCU12051 | 1 | 175 | 69 | 129 | 123 | 14 |
| NCU12128 | 4 | 105 | 38 | 75 | 83 | 10 |
| NCU12145 | 1 | 25 | 16 | 45 | 34 | 2 |
| NCU00289 | 187 | 105 | 358 | 233 | 174 | 281 |
| NCU00496 | 14 | 15 | 53 | 29 | 30 | 13 |
| NCU00763 | 0.01 | 0.01 | 156 | 1 | 1 | 0.01 |
| NCU01386 | 111 | 69 | 330 | 227 | 130 | 89 |
| NCU02485 | 16 | 30 | 267 | 70 | 117 | 291 |
| NCU02882 | 110 | 16 | 244 | 50 | 64 | 110 |
| NCU04618 | 30 | 35 | 171 | 56 | 80 | 18 |
| NCU04871 | 0.01 | 1 | 20 | 5 | 3 | 2 |
| NCU04904 | 336 | 572 | 1657 | 872 | 880 | 731 |
| NCU05351 | 20 | 14 | 61 | 45 | 26 | 0.01 |
| NCU05501 | 12 | 55 | 470 | 151 | 120 | 128 |
| NCU05906 | 9 | 207 | 501 | 304 | 274 | 340 |
| NCU06373 | 9 | 42 | 228 | 92 | 82 | 12 |
| NCU07270 | 11 | 19 | 62 | 26 | 33 | 49 |
| NCU08116 | 2 | 3 | 15 | 6 | 8 | 0.01 |
| NCU08397 | 12 | 224 | 1466 | 1969 | 617 | 81 |
| NCU08748 | 77 | 71 | 188 | 101 | 116 | 186 |
| NCU08867 | 87 | 17 | 168 | 47 | 42 | 34 |
| NCU09176 | 10 | 63 | 573 | 152 | 198 | 194 |
| NCU11769 | 8 | 6 | 23 | 9 | 12 | 8 |
| NCU11828 | 912 | 76 | 895 | 237 | 210 | 99 |
| NCU11905 | 2 | 3 | 26 | 11 | 8 | 0.01 |
| NCU00011 | 0.01 | 21 | 6 | 11 | 10 | 0.01 |
| NCU00397 | 259 | 1679 | 656 | 890 | 836 | 616 |
| NCU00510 | 3 | 60 | 20 | 30 | 28 | 0.01 |
| NCU00935 | 1326 | 1592 | 327 | 535 | 546 | 924 |
| NCU01880 | 4 | 52 | 17 | 28 | 31 | 0.01 |

TABLE 1C-continued

FPKMs identified from profiling data in different mutant strains and growth conditions

| Gene | Sucrose | No Carbon | Cellulose | Δclr-1 | Δclr-2 | Xylan FPKM |
|---|---|---|---|---|---|---|
| NCU02080 | 318 | 663 | 153 | 347 | 248 | 43 |
| NCU02130 | 35 | 552 | 169 | 311 | 337 | 71 |
| NCU02163 | 10 | 66 | 18 | 33 | 29 | 7 |
| NCU02365 | 0.01 | 46 | 11 | 16 | 20 | 0.01 |
| NCU03157 | 21 | 128 | 41 | 62 | 67 | 42 |
| NCU03352 | 221 | 157 | 70 | 98 | 97 | 70 |
| NCU03398 | 13 | 502 | 241 | 284 | 376 | 67 |
| NCU03570 | 2 | 49 | 9 | 19 | 23 | 0.01 |
| NCU04282 | 4 | 180 | 40 | 83 | 71 | 23 |
| NCU04342 | 279 | 836 | 312 | 553 | 295 | 444 |
| NCU04360 | 91 | 404 | 125 | 232 | 181 | 91 |
| NCU04525 | 157 | 394 | 88 | 174 | 167 | 369 |
| NCU04866 | 26 | 374 | 36 | 149 | 105 | 65 |
| NCU05784 | 8 | 201 | 37 | 72 | 75 | 34 |
| NCU05951 | 4 | 231 | 51 | 89 | 85 | 43 |
| NCU05976 | 3 | 15 | 3 | 7 | 4 | 0.01 |
| NCU06156 | 4 | 272 | 137 | 199 | 194 | 47 |
| NCU06986 | 1777 | 5683 | 1405 | 2505 | 2588 | 2099 |
| NCU07126 | 143 | 143 | 68 | 94 | 79 | 49 |
| NCU07593 | 0.01 | 19 | 3 | 9 | 5 | 0.01 |
| NCU07718 | 0.01 | 1234 | 102 | 379 | 310 | 9 |
| NCU08224 | 482 | 1740 | 423 | 782 | 812 | 3564 |
| NCU08469 | 3 | 864 | 221 | 427 | 452 | 263 |
| NCU08726 | 34 | 225 | 72 | 128 | 124 | 46 |
| NCU09049 | 1 | 115 | 16 | 36 | 31 | 0.01 |
| NCU09115 | 89 | 1644 | 571 | 771 | 869 | 478 |
| NCU09883 | 74 | 551 | 156 | 324 | 288 | 133 |
| NCU10658 | 102 | 303 | 113 | 186 | 169 | 129 |
| NCU10770 | 7 | 21 | 4 | 8 | 8 | 0.01 |
| NCU11294 | 20 | 158 | 32 | 92 | 51 | 101 |
| NCU00304 | 297 | 480 | 1160 | 1340 | 1020 | 820 |
| NCU00798 | 1356 | 182 | 928 | 1074 | 1075 | 1877 |
| NCU01136 | 81 | 36 | 80 | 94 | 95 | 200 |
| NCU01430 | 8 | 92 | 670 | 291 | 316 | 1699 |
| NCU03791 | 4480 | 221 | 524 | 572 | 481 | 1376 |
| NCU04167 | 5 | 19 | 58 | 195 | 131 | 21 |
| NCU04400 | 1 | 78 | 1893 | 963 | 1385 | 2507 |
| NCU04557 | 1 | 2 | 27 | 15 | 13 | 6 |
| NCU04879 | 10 | 0.01 | 11 | 56 | 27 | 0.01 |
| NCU04910 | 1554 | 3082 | 8104 | 6702 | 5873 | 9988 |
| NCU04928 | 16 | 3 | 22 | 18 | 10 | 0.01 |
| NCU05068 | 39 | 39 | 2321 | 1095 | 1569 | 121 |
| NCU05755 | 52 | 123 | 589 | 625 | 629 | 552 |
| NCU05826 | 791 | 25 | 177 | 174 | 157 | 630 |
| NCU05832 | 806 | 544 | 2806 | 1841 | 1558 | 3059 |
| NCU05875 | 4 | 26 | 53 | 77 | 69 | 18 |
| NCU05909 | 3 | 1 | 32 | 16 | 11 | 14 |
| NCU06181 | 85 | 37 | 108 | 88 | 99 | 79 |
| NCU06235 | 326 | 34 | 105 | 115 | 78 | 111 |
| NCU06387 | 77 | 42 | 367 | 199 | 234 | 116 |
| NCU07235 | 4 | 0.01 | 8 | 26 | 20 | 12 |
| NCU07510 | 0.01 | 0.01 | 129 | 129 | 176 | 233 |
| NCU07572 | 59 | 63 | 124 | 243 | 172 | 87 |
| NCU07997 | 161 | 299 | 781 | 976 | 835 | 547 |
| NCU08383 | 0.01 | 1 | 15 | 16 | 16 | 8 |
| NCU08491 | 0.01 | 1254 | 1223 | 1737 | 1330 | 63 |
| NCU08634 | 4 | 28 | 58 | 91 | 78 | 18 |
| NCU09075 | 10 | 0.01 | 6 | 23 | 10 | 0.01 |
| NCU09415 | 84 | 10 | 213 | 86 | 96 | 248 |
| NCU09856 | 6 | 26 | 102 | 103 | 74 | 93 |
| NCU09874 | 306 | 303 | 696 | 4320 | 2036 | 525 |
| NCU09906 | 47 | 38 | 151 | 256 | 206 | 363 |
| NCU10284 | 488 | 46 | 318 | 259 | 154 | 462 |
| NCU10697 | 18 | 20 | 154 | 94 | 129 | 15 |
| NCU11095 | 7 | 8 | 32 | 23 | 24 | 9 |
| NCU11291 | 11 | 9 | 58 | 32 | 29 | 10 |
| NCU11689 | 5 | 3 | 28 | 105 | 72 | 15 |
| NCU11801 | 4 | 5 | 20 | 22 | 21 | 6 |
| NCU11932 | 0.01 | 47 | 342 | 158 | 286 | 419 |
| NCU00365 | 361 | 582 | 249 | 202 | 195 | 339 |
| NCU00375 | 15 | 204 | 42 | 67 | 54 | 26 |
| NCU00755 | 5 | 370 | 39 | 57 | 53 | 15 |
| NCU01109 | 0.01 | 122 | 14 | 23 | 25 | 0.01 |
| NCU01292 | 16 | 26 | 14 | 13 | 12 | 19 |

TABLE 1C-continued

FPKMs identified from profiling data in different mutant strains and growth conditions

| Gene | Sucrose | No Carbon | Cellulose | Δclr-1 | Δclr-2 | Xylan FPKM |
|---|---|---|---|---|---|---|
| NCU01551 | 78 | 423 | 168 | 176 | 193 | 57 |
| NCU01649 | 395 | 416 | 153 | 217 | 170 | 293 |
| NCU03011 | 1 | 98 | 4 | 7 | 4 | 0.01 |
| NCU03417 | 67 | 297 | 88 | 109 | 105 | 41 |
| NCU04285 | 1 | 19 | 5 | 6 | 4 | 0.01 |
| NCU04843 | 546 | 2230 | 885 | 985 | 1378 | 371 |
| NCU04851 | 44 | 91 | 42 | 51 | 50 | 54 |
| NCU04861 | 3 | 61 | 16 | 21 | 22 | 8 |
| NCU04862 | 49 | 668 | 245 | 247 | 294 | 91 |
| NCU05006 | 99 | 1078 | 194 | 211 | 241 | 179 |
| NCU05189 | 8 | 101 | 12 | 17 | 13 | 8 |
| NCU05197 | 71 | 51 | 42 | 42 | 36 | 24 |
| NCU05477 | 17 | 60 | 18 | 12 | 12 | 16 |
| NCU05762 | 0.01 | 13 | 0.01 | 0.01 | 0.01 | 0.01 |
| NCU05764 | 0.01 | 11 | 0.01 | 0.01 | 0.01 | 0.01 |
| NCU05766 | 0.01 | 119 | 32 | 39 | 44 | 16 |
| NCU05859 | 1 | 34 | 9 | 4 | 6 | 4 |
| NCU05933 | 4 | 59 | 27 | 30 | 31 | 6 |
| NCU06334 | 50 | 529 | 158 | 140 | 155 | 42 |
| NCU07180 | 5 | 44 | 18 | 21 | 21 | 6 |
| NCU07363 | 1208 | 5311 | 1592 | 2150 | 2283 | 1156 |
| NCU08037 | 5 | 924 | 227 | 209 | 290 | 8 |
| NCU08155 | 77 | 1590 | 216 | 354 | 221 | 192 |
| NCU08156 | 13 | 275 | 43 | 45 | 40 | 23 |
| NCU08170 | 7 | 33 | 16 | 15 | 14 | 21 |
| NCU08455 | 20 | 1198 | 153 | 230 | 290 | 50 |
| NCU08554 | 899 | 3675 | 1509 | 1940 | 1750 | 838 |
| NCU08622 | 0.01 | 40 | 14 | 17 | 19 | 0.01 |
| NCU08700 | 28 | 116 | 51 | 45 | 48 | 80 |
| NCU08775 | 12 | 197 | 60 | 54 | 48 | 13 |
| NCU09272 | 16 | 394 | 68 | 68 | 78 | 25 |
| NCU09273 | 45 | 800 | 106 | 76 | 92 | 53 |
| NCU09274 | 31 | 1352 | 109 | 93 | 117 | 36 |
| NCU09335 | 15 | 448 | 133 | 151 | 213 | 50 |
| NCU09342 | 3 | 18 | 2 | 3 | 2 | 0.01 |
| NCU09714 | 10 | 256 | 119 | 136 | 130 | 82 |
| NCU09782 | 113 | 736 | 273 | 286 | 384 | 124 |
| NCU10062 | 305 | 169 | 71 | 81 | 91 | 86 |
| NCU10301 | 7 | 103 | 51 | 65 | 42 | 36 |
| NCU11565 | 29 | 89 | 64 | 56 | 60 | 23 |
| NCU11774 | 1744 | 31112 | 14608 | 17568 | 17970 | 5816 |
| NCU11881 | 72 | 587 | 201 | 227 | 263 | 133 |
| NCU11974 | 603 | 8076 | 1100 | 1707 | 1525 | 288 |
| NCU11989 | 36 | 812 | 234 | 272 | 343 | 76 |
| NCU12012 | 0.01 | 7 | 0.01 | 0.01 | 0.01 | 0.01 |
| NCU12014 | 0.01 | 6 | 0.01 | 0.01 | 0.01 | 0.01 |
| NCU12015 | 0.01 | 6 | 0.01 | 0.01 | 0.01 | 0.01 |

TABLE 1D

Differential expression (DE) patterns between various mutant strains and growth conditions*

| Gene | Avicel v No Carbon DE | Avicel v Δclr-1 DE | Avicel v Δclr-2 DE | Sucrose v No Carbon DE | Avicel v Sucrose DE |
|---|---|---|---|---|---|
| NCU00554 | yes | yes | yes | yes | yes |
| NCU00944 | cuffdiff | yes | cuffdiff | | cuffdiff |
| NCU01195 | cuffdiff | yes | cuffdiff | yes | yes |
| NCU02785 | yes | cuffdiff | cuffdiff | yes | yes |
| NCU02954 | cuffdiff | cuffdiff | yes | yes | yes |
| NCU03131 | yes | cuffdiff | cuffdiff | cuffdiff | cuffdiff |
| NCU04216 | cuffdiff | yes | yes | yes | yes |
| NCU04298 | yes | cuffdiff | cuffdiff | yes | yes |
| NCU04837 | cuffdiff | yes | cuffdiff | yes | yes |
| NCU05548 | yes | yes | yes | yes | cuffdiff |
| NCU07413 | yes | yes | yes | cuffdiff | cuffdiff |
| NCU10283 | yes | yes | yes | yes | cuffdiff |
| NCU00461 | cuffdiff | yes | cuffdiff | yes | yes |
| NCU00591 | yes | yes | yes | yes | yes |
| NCU00680 | yes | yes | cuffdiff | cuffdiff | cuffdiff |
| NCU01402 | cuffdiff | yes | yes | yes | yes |
| NCU02127 | yes | yes | yes | yes | yes |
| NCU02704 | cuffdiff | yes | yes | yes | cuffdiff |
| NCU02727 | cuffdiff | yes | cuffdiff | cuffdiff | cuffdiff |
| NCU02936 | yes | yes | yes | yes | cuffdiff |
| NCU03076 | cuffdiff | yes | yes | cuffdiff | |
| NCU03415 | yes | yes | yes | yes | yes |
| NCU03648 | cuffdiff | yes | yes | yes | yes |
| NCU03913 | cuffdiff | yes | yes | yes | cuffdiff |
| NCU05499 | cuffdiff | yes | yes | yes | yes |
| NCU05537 | cuffdiff | yes | yes | yes | yes |
| NCU05977 | yes | yes | yes | yes | yes |
| NCU06448 | cuffdiff | yes | cuffdiff | cuffdiff | |

TABLE 1D-continued

Differential expression (DE) patterns between various mutant strains and growth conditions*

| Gene | Avicel v No Carbon DE | Avicel v Δclr-1 DE | Avicel v Δclr-2 DE | Sucrose v No Carbon DE | Avicel v Sucrose DE |
|---|---|---|---|---|---|
| NCU06543 | cuffdiff | yes | cuffdiff | yes | cuffdiff |
| NCU07153 | cuffdiff | yes | yes | cuffdiff | cuffdiff |
| NCU08216 | cuffdiff | yes | yes | cuffdiff | yes |
| NCU09116 | yes | yes | yes | cuffdiff | yes |
| NCU09266 | cuffdiff | yes | cuffdiff | yes | yes |
| NCU09864 | cuffdiff | yes | yes | yes | yes |
| NCU11195 | yes | cuffdiff | cuffdiff | yes | cuffdiff |
| NCU01830 | cuffdiff | cuffdiff | yes | yes | yes |
| NCU02126 | yes | yes | yes | yes | yes |
| NCU01744 | yes | cuffdiff | cuffdiff | yes | cuffdiff |
| NCU03748 | yes | cuffdiff | cuffdiff | yes | yes |
| NCU06625 | yes | cuffdiff | cuffdiff | yes | |
| NCU04130 | yes | cuffdiff | cuffdiff | cuffdiff | yes |
| NCU10110 | yes | cuffdiff | cuffdiff | yes | yes |
| NCU03861 | yes | | | yes | yes |
| NCU07623 | yes | | | yes | yes |
| NCU01427 | yes | | cuffdiff | yes | yes |
| NCU03651 | yes | cuffdiff | yes | yes | cuffdiff |
| NCU02579 | yes | cuffdiff | cuffdiff | yes | yes |
| NCU07307 | yes | | | yes | yes |
| NCU07308 | yes | | | yes | yes |
| NCU05858 | yes | | | yes | yes |
| NCU01013 | yes | yes | yes | cuffdiff | cuffdiff |
| NCU06189 | yes | cuffdiff | cuffdiff | yes | yes |
| NCU05165 | cuffdiff | yes | cuffdiff | cuffdiff | cuffdiff |
| NCU04865 | yes | | cuffdiff | yes | cuffdiff |
| NCU05011 | yes | | | | yes |
| NCU00762 | yes | yes | yes | | yes |
| NCU00836 | yes | yes | yes | | yes |
| NCU01050 | yes | yes | yes | cuffdiff | yes |
| NCU02240 | yes | yes | yes | yes | yes |
| NCU02344 | yes | yes | yes | yes | cuffdiff |
| NCU02916 | yes | yes | yes | | yes |
| NCU03328 | yes | yes | yes | yes | yes |
| NCU04854 | yes | yes | yes | yes | yes |
| NCU05057 | yes | yes | yes | yes | yes |
| NCU05121 | yes | yes | yes | yes | yes |
| NCU07190 | yes | yes | yes | cuffdiff | yes |
| NCU07340 | yes | yes | yes | cuffdiff | yes |
| NCU07760 | yes | yes | yes | yes | cuffdiff |
| NCU07898 | yes | yes | yes | yes | yes |
| NCU08760 | yes | yes | yes | | yes |
| NCU09680 | yes | yes | yes | | yes |
| NCU03322 | yes | cuffdiff | cuffdiff | yes | yes |
| NCU07362 | yes | cuffdiff | cuffdiff | yes | cuffdiff |
| NCU03813 | yes | cuffdiff | cuffdiff | yes | yes |
| NCU04539 | yes | | | yes | yes |
| NCU08687 | yes | yes | yes | cuffdiff | yes |
| NCU05133 | yes | cuffdiff | cuffdiff | yes | cuffdiff |
| NCU09705 | yes | cuffdiff | cuffdiff | yes | yes |
| NCU07277 | yes | cuffdiff | cuffdiff | cuffdiff | cuffdiff |
| NCU04797 | yes | yes | cuffdiff | yes | cuffdiff |
| NCU00575 | yes | cuffdiff | cuffdiff | yes | yes |
| NCU04401 | yes | cuffdiff | cuffdiff | yes | yes |
| NCU02855 | yes | yes | yes | | yes |
| NCU05924 | yes | yes | yes | | yes |
| NCU05955 | yes | yes | yes | yes | yes |
| NCU07326 | yes | yes | yes | yes | yes |
| NCU09775 | yes | cuffdiff | yes | cuffdiff | yes |
| NCU04997 | yes | yes | yes | | yes |
| NCU01900 | yes | cuffdiff | cuffdiff | yes | yes |
| NCU02343 | yes | cuffdiff | cuffdiff | yes | yes |
| NCU07225 | yes | yes | yes | cuffdiff | yes |
| NCU08087 | yes | cuffdiff | cuffdiff | yes | cuffdiff |
| NCU08189 | yes | | cuffdiff | yes | yes |
| NCU09652 | yes | | cuffdiff | yes | yes |
| NCU06881 | cuffdiff | yes | cuffdiff | | cuffdiff |
| NCU01853 | cuffdiff | yes | yes | yes | yes |
| NCU02287 | cuffdiff | yes | yes | yes | cuffdiff |
| NCU02894 | yes | cuffdiff | cuffdiff | cuffdiff | |
| NCU07263 | yes | yes | cuffdiff | | yes |
| NCU08924 | yes | cuffdiff | cuffdiff | yes | yes |
| NCU09692 | yes | cuffdiff | cuffdiff | yes | yes |
| NCU04796 | yes | cuffdiff | cuffdiff | yes | yes |
| NCU09732 | cuffdiff | yes | cuffdiff | yes | cuffdiff |
| NCU07719 | yes | yes | cuffdiff | cuffdiff | cuffdiff |
| NCU12093 | yes | yes | cuffdiff | yes | yes |
| NCU05818 | yes | | | yes | yes |
| NCU04078 | yes | yes | yes | yes | yes |
| NCU07617 | yes | | | yes | cuffdiff |
| NCU08398 | yes | yes | yes | yes | yes |
| NCU10683 | cuffdiff | cuffdiff | yes | yes | yes |
| NCU10063 | yes | | | yes | cuffdiff |
| NCU04933 | yes | cuffdiff | cuffdiff | | cuffdiff |
| NCU00890 | yes | yes | yes | yes | yes |
| NCU04623 | yes | yes | cuffdiff | yes | yes |
| NCU04952 | yes | yes | yes | yes | yes |
| NCU05956 | cuffdiff | yes | cuffdiff | yes | yes |
| NCU07487 | yes | yes | yes | | yes |
| NCU08755 | yes | yes | cuffdiff | yes | yes |
| NCU00130 | yes | yes | yes | yes | yes |
| NCU00709 | yes | cuffdiff | cuffdiff | | |
| NCU04168 | yes | yes | cuffdiff | yes | |
| NCU09904 | yes | cuffdiff | | | yes |
| NCU09923 | yes | cuffdiff | cuffdiff | yes | yes |
| NCU03098 | yes | | cuffdiff | yes | yes |
| NCU09028 | yes | | | yes | cuffdiff |
| NCU09281 | yes | cuffdiff | cuffdiff | yes | yes |
| NCU10107 | yes | cuffdiff | cuffdiff | yes | yes |
| NCU00206 | yes | yes | yes | | yes |
| NCU00710 | yes | yes | yes | yes | yes |
| NCU01059 | yes | yes | cuffdiff | | yes |
| NCU03181 | yes | yes | yes | yes | yes |
| NCU04494 | yes | yes | yes | | yes |
| NCU05598 | yes | yes | yes | cuffdiff | cuffdiff |
| NCU05751 | yes | yes | yes | | yes |
| NCU08176 | yes | yes | yes | | yes |
| NCU08746 | yes | yes | yes | yes | yes |
| NCU08785 | yes | yes | yes | yes | yes |
| NCU09445 | yes | yes | yes | cuffdiff | yes |
| NCU09491 | yes | yes | yes | yes | yes |
| NCU09582 | yes | yes | yes | | yes |
| NCU09764 | yes | yes | yes | yes | yes |
| NCU09774 | yes | yes | yes | | yes |
| NCU09976 | yes | yes | yes | | yes |
| NCU10045 | yes | yes | yes | cuffdiff | yes |
| NCU11068 | yes | yes | yes | yes | yes |
| NCU11198 | yes | yes | yes | | yes |
| NCU02904 | yes | cuffdiff | cuffdiff | yes | |
| NCU04870 | yes | yes | yes | | yes |
| NCU05159 | yes | yes | yes | yes | yes |
| NCU09518 | yes | cuffdiff | cuffdiff | yes | yes |
| NCU09664 | yes | yes | yes | | yes |
| NCU09924 | yes | yes | yes | yes | yes |
| NCU03158 | yes | | | cuffdiff | cuffdiff |
| NCU07067 | yes | cuffdiff | cuffdiff | yes | yes |
| NCU01353 | yes | cuffdiff | cuffdiff | yes | cuffdiff |
| NCU07269 | yes | | | yes | yes |
| NCU06023 | yes | | | yes | |
| NCU06025 | yes | | | cuffdiff | |
| NCU00761 | yes | yes | yes | | yes |
| NCU06650 | cuffdiff | cuffdiff | yes | yes | yes |
| NCU09416 | yes | yes | yes | cuffdiff | yes |
| NCU00292 | yes | | cuffdiff | yes | yes |
| NCU03903 | yes | cuffdiff | cuffdiff | yes | yes |
| NCU04475 | yes | cuffdiff | cuffdiff | yes | yes |
| NCU06364 | yes | cuffdiff | cuffdiff | cuffdiff | cuffdiff |
| NCU09575 | yes | | | yes | yes |
| NCU04230 | yes | yes | cuffdiff | yes | cuffdiff |
| NCU02366 | yes | | | yes | cuffdiff |
| NCU04280 | yes | | | yes | yes |
| NCU04385 | yes | | | yes | yes |
| NCU02969 | yes | | | cuffdiff | yes |
| NCU08164 | yes | cuffdiff | cuffdiff | cuffdiff | yes |
| NCU00891 | yes | | cuffdiff | cuffdiff | yes |
| NCU08384 | yes | cuffdiff | | | yes |

TABLE 1D-continued

Differential expression (DE) patterns between various mutant strains and growth conditions*

| Gene | Avicel v No Carbon DE | Avicel v Δclr-1 DE | Avicel v Δclr-2 DE | Sucrose v No Carbon DE | Avicel v Sucrose DE |
|---|---|---|---|---|---|
| NCU08272 | cuffdiff | yes | cuffdiff | cuffdiff | |
| NCU07619 | yes | | | yes | |
| NCU05304 | yes | yes | cuffdiff | yes | yes |
| NCU01510 | yes | cuffdiff | cuffdiff | yes | yes |
| NCU05768 | yes | cuffdiff | | yes | cuffdiff |
| NCU07154 | yes | cuffdiff | cuffdiff | yes | yes |
| NCU01998 | yes | | cuffdiff | yes | cuffdiff |
| NCU08457 | yes | cuffdiff | cuffdiff | yes | yes |
| NCU06386 | yes | cuffdiff | cuffdiff | | cuffdiff |
| NCU09425 | yes | cuffdiff | cuffdiff | yes | yes |
| NCU02478 | yes | cuffdiff | | yes | cuffdiff |
| NCU09175 | yes | cuffdiff | cuffdiff | cuffdiff | yes |
| NCU01689 | cuffdiff | yes | cuffdiff | yes | yes |
| NCU11721 | cuffdiff | yes | yes | cuffdiff | cuffdiff |
| NCU02396 | yes | cuffdiff | | cuffdiff | yes |
| NCU07481 | yes | | | yes | |
| NCU03137 | yes | cuffdiff | cuffdiff | cuffdiff | |
| NCU02500 | cuffdiff | yes | yes | yes | yes |
| NCU00565 | yes | yes | cuffdiff | cuffdiff | yes |
| NCU02705 | cuffdiff | yes | yes | yes | yes |
| NCU05225 | yes | | | cuffdiff | cuffdiff |
| NCU08326 | cuffdiff | yes | | cuffdiff | cuffdiff |
| NCU00326 | yes | yes | yes | cuffdiff | yes |
| NCU08691 | yes | | | yes | yes |
| NCU09043 | yes | cuffdiff | cuffdiff | yes | yes |
| NCU07432 | yes | cuffdiff | cuffdiff | | cuffdiff |
| NCU05841 | yes | cuffdiff | yes | yes | cuffdiff |
| NCU02361 | cuffdiff | yes | cuffdiff | | |
| NCU10051 | yes | cuffdiff | cuffdiff | yes | cuffdiff |
| NCU04720 | yes | cuffdiff | cuffdiff | yes | cuffdiff |
| NCU04698 | yes | cuffdiff | cuffdiff | yes | cuffdiff |
| NCU00177 | cuffdiff | yes | cuffdiff | yes | yes |
| NCU01786 | cuffdiff | yes | cuffdiff | yes | cuffdiff |
| NCU03117 | cuffdiff | yes | yes | yes | yes |
| NCU05254 | cuffdiff | yes | cuffdiff | yes | cuffdiff |
| NCU03963 | yes | yes | yes | yes | yes |
| NCU09659 | cuffdiff | yes | cuffdiff | yes | yes |
| NCU03488 | yes | cuffdiff | cuffdiff | cuffdiff | yes |
| NCU02657 | yes | cuffdiff | cuffdiff | yes | yes |
| NCU05855 | yes | yes | yes | | yes |
| NCU08044 | yes | cuffdiff | yes | | yes |
| NCU09283 | cuffdiff | yes | cuffdiff | yes | yes |
| NCU11243 | cuffdiff | yes | yes | yes | yes |
| NCU01378 | yes | cuffdiff | cuffdiff | yes | cuffdiff |
| NCU01861 | yes | yes | yes | yes | yes |
| NCU04583 | cuffdiff | yes | yes | cuffdiff | cuffdiff |
| NCU06616 | yes | yes | cuffdiff | yes | yes |
| NCU07325 | yes | cuffdiff | cuffdiff | yes | yes |
| NCU08771 | yes | yes | cuffdiff | yes | yes |
| NCU09553 | cuffdiff | cuffdiff | cuffdiff | cuffdiff | |
| NCU10055 | cuffdiff | yes | yes | yes | yes |
| NCU11289 | yes | | | yes | |
| NCU08750 | yes | yes | cuffdiff | yes | yes |
| NCU08752 | yes | yes | cuffdiff | yes | yes |
| NCU03049 | yes | | | yes | yes |
| NCU05653 | yes | | | yes | yes |
| NCU07133 | yes | cuffdiff | cuffdiff | yes | yes |
| NCU08925 | yes | cuffdiff | | yes | |
| NCU09865 | yes | | | yes | |
| NCU11365 | yes | cuffdiff | | cuffdiff | |
| NCU07055 | yes | cuffdiff | cuffdiff | yes | yes |
| NCU07224 | yes | yes | yes | | yes |
| NCU01061 | yes | | | yes | |
| NCU03566 | yes | | | yes | cuffdiff |
| NCU04260 | yes | | cuffdiff | yes | yes |
| NCU05094 | yes | | cuffdiff | yes | yes |
| NCU05986 | yes | | | yes | cuffdiff |
| NCU06153 | yes | cuffdiff | yes | yes | yes |
| NCU09674 | yes | | | cuffdiff | cuffdiff |
| NCU11241 | yes | cuffdiff | cuffdiff | yes | cuffdiff |
| NCU03013 | yes | cuffdiff | cuffdiff | yes | yes |
| NCU05319 | yes | cuffdiff | cuffdiff | yes | yes |
| NCU04430 | cuffdiff | yes | yes | yes | yes |
| NCU02059 | yes | yes | yes | yes | cuffdiff |
| NCU00831 | cuffdiff | yes | cuffdiff | yes | cuffdiff |
| NCU06055 | yes | cuffdiff | cuffdiff | | cuffdiff |
| NCU00263 | cuffdiff | yes | cuffdiff | cuffdiff | cuffdiff |
| NCU07200 | cuffdiff | yes | cuffdiff | cuffdiff | cuffdiff |
| NCU09992 | cuffdiff | yes | cuffdiff | yes | yes |
| NCU09265 | yes | yes | yes | cuffdiff | yes |
| NCU00813 | yes | yes | yes | cuffdiff | yes |
| NCU02455 | yes | cuffdiff | cuffdiff | | yes |
| NCU09223 | yes | yes | yes | cuffdiff | yes |
| NCU09485 | yes | yes | yes | cuffdiff | cuffdiff |
| NCU01648 | yes | cuffdiff | cuffdiff | yes | cuffdiff |
| NCU10497 | yes | yes | cuffdiff | cuffdiff | cuffdiff |
| NCU00669 | yes | yes | cuffdiff | yes | cuffdiff |
| NCU02118 | yes | cuffdiff | cuffdiff | cuffdiff | |
| NCU10762 | yes | cuffdiff | cuffdiff | yes | |
| NCU00244 | yes | | | cuffdiff | cuffdiff |
| NCU01068 | yes | yes | cuffdiff | yes | yes |
| NCU03319 | yes | cuffdiff | cuffdiff | | yes |
| NCU08761 | yes | yes | cuffdiff | cuffdiff | cuffdiff |
| NCU01279 | yes | cuffdiff | cuffdiff | cuffdiff | cuffdiff |
| NCU03819 | yes | cuffdiff | cuffdiff | cuffdiff | cuffdiff |
| NCU08607 | yes | cuffdiff | cuffdiff | | cuffdiff |
| NCU09195 | yes | cuffdiff | cuffdiff | cuffdiff | |
| NCU07736 | yes | cuffdiff | cuffdiff | yes | cuffdiff |
| NCU01290 | cuffdiff | yes | cuffdiff | yes | yes |
| NCU03396 | cuffdiff | yes | yes | yes | yes |
| NCU09521 | cuffdiff | yes | yes | yes | yes |
| NCU03897 | cuffdiff | yes | cuffdiff | yes | cuffdiff |
| NCU07746 | yes | cuffdiff | cuffdiff | cuffdiff | cuffdiff |
| NCU08897 | yes | yes | yes | cuffdiff | cuffdiff |
| NCU00169 | yes | yes | yes | yes | yes |
| NCU02681 | yes | cuffdiff | yes | cuffdiff | cuffdiff |
| NCU06333 | yes | yes | yes | cuffdiff | yes |
| NCU01146 | yes | cuffdiff | cuffdiff | yes | cuffdiff |
| NCU00931 | yes | | | yes | yes |
| NCU07008 | yes | | | yes | cuffdiff |
| NCU03295 | cuffdiff | yes | cuffdiff | yes | yes |
| NCU07737 | yes | yes | cuffdiff | cuffdiff | cuffdiff |
| NCU08038 | yes | cuffdiff | cuffdiff | yes | yes |
| NCU02729 | cuffdiff | yes | cuffdiff | yes | yes |
| NCU03364 | cuffdiff | yes | cuffdiff | yes | yes |
| NCU03817 | yes | | | cuffdiff | |
| NCU06111 | yes | | | cuffdiff | yes |
| NCU08115 | yes | yes | cuffdiff | | yes |
| NCU06931 | yes | cuffdiff | cuffdiff | yes | yes |
| NCU04077 | yes | cuffdiff | cuffdiff | yes | yes |
| NCU01862 | yes | yes | cuffdiff | yes | yes |
| NCU02795 | yes | | | yes | |
| NCU00812 | yes | yes | cuffdiff | yes | cuffdiff |
| NCU01856 | yes | yes | yes | cuffdiff | cuffdiff |
| NCU03725 | yes | yes | yes | yes | cuffdiff |
| NCU06971 | yes | yes | yes | yes | yes |
| NCU07705 | yes | yes | cuffdiff | yes | yes |
| NCU08042 | yes | yes | yes | yes | yes |
| NCU03643 | yes | yes | yes | yes | yes |
| NCU03043 | yes | cuffdiff | cuffdiff | yes | cuffdiff |
| NCU05767 | yes | | | yes | yes |
| NCU00316 | cuffdiff | yes | cuffdiff | cuffdiff | |
| NCU00721 | cuffdiff | yes | yes | yes | cuffdiff |
| NCU07578 | cuffdiff | yes | yes | yes | yes |
| NCU04435 | yes | | | | |
| NCU05198 | yes | | | cuffdiff | yes |
| NCU10721 | yes | yes | yes | yes | yes |
| NCU11342 | yes | yes | yes | yes | yes |
| NCU00821 | cuffdiff | yes | cuffdiff | yes | cuffdiff |
| NCU08561 | yes | yes | yes | yes | cuffdiff |
| NCU09287 | cuffdiff | yes | cuffdiff | yes | yes |
| NCU00801 | yes | yes | yes | yes | yes |
| NCU00809 | yes | cuffdiff | cuffdiff | cuffdiff | yes |
| NCU07668 | yes | cuffdiff | cuffdiff | | yes |
| NCU05089 | yes | | | cuffdiff | yes |
| NCU08152 | yes | cuffdiff | cuffdiff | yes | yes |

TABLE 1D-continued

Differential expression (DE) patterns between various mutant strains and growth conditions*

| Gene | Avicel v No Carbon DE | Avicel v Δclr-1 DE | Avicel v Δclr-2 DE | Sucrose v No Carbon DE | Avicel v Sucrose DE |
|---|---|---|---|---|---|
| NCU01633 | cuffdiff | yes | cuffdiff | yes | yes |
| NCU04537 | yes | cuffdiff | cuffdiff | | yes |
| NCU05853 | yes | cuffdiff | cuffdiff | yes | yes |
| NCU08114 | yes | yes | cuffdiff | yes | yes |
| NCU00023 | cuffdiff | yes | yes | cuffdiff | yes |
| NCU02009 | yes | yes | yes | cuffdiff | yes |
| NCU07068 | yes | cuffdiff | cuffdiff | yes | yes |
| NCU03305 | yes | cuffdiff | cuffdiff | cuffdiff | cuffdiff |
| NCU08225 | yes | cuffdiff | cuffdiff | yes | yes |
| NCU08147 | yes | cuffdiff | cuffdiff | yes | yes |
| NCU06366 | yes | | | cuffdiff | cuffdiff |
| NCU05585 | yes | cuffdiff | cuffdiff | yes | yes |
| NCU06138 | yes | cuffdiff | cuffdiff | yes | yes |
| NCU05591 | yes | cuffdiff | | | yes |
| NCU06032 | yes | yes | yes | cuffdiff | yes |
| NCU09098 | yes | yes | yes | | yes |
| NCU10009 | yes | cuffdiff | cuffdiff | cuffdiff | |
| NCU00290 | yes | yes | | | yes |
| NCU09580 | yes | | | yes | |
| NCU00803 | yes | | | yes | yes |
| NCU04374 | yes | | cuffdiff | yes | cuffdiff |
| NCU08425 | yes | yes | yes | yes | cuffdiff |
| NCU04097 | cuffdiff | yes | cuffdiff | yes | yes |
| NCU05079 | cuffdiff | yes | cuffdiff | cuffdiff | cuffdiff |
| NCU07546 | yes | cuffdiff | cuffdiff | | yes |
| NCU08148 | cuffdiff | yes | | yes | cuffdiff |
| NCU03107 | yes | | | yes | |
| NCU00586 | yes | yes | yes | yes | cuffdiff |
| NCU00716 | cuffdiff | yes | | yes | cuffdiff |
| NCU00025 | yes | cuffdiff | cuffdiff | yes | yes |
| NCU00848 | yes | | | yes | yes |
| NCU00449 | yes | yes | yes | cuffdiff | yes |
| NCU00849 | yes | | cuffdiff | yes | |
| NCU01058 | yes | yes | cuffdiff | yes | yes |
| NCU01076 | yes | yes | yes | cuffdiff | |
| NCU01196 | cuffdiff | cuffdiff | yes | | cuffdiff |
| NCU01978 | cuffdiff | yes | cuffdiff | | yes |
| NCU02138 | cuffdiff | yes | yes | cuffdiff | cuffdiff |
| NCU03083 | yes | yes | yes | yes | cuffdiff |
| NCU03982 | yes | yes | yes | cuffdiff | yes |
| NCU04948 | yes | yes | cuffdiff | yes | yes |
| NCU05230 | yes | yes | cuffdiff | | yes |
| NCU05863 | yes | yes | yes | yes | yes |
| NCU05864 | yes | yes | yes | yes | yes |
| NCU06152 | cuffdiff | yes | cuffdiff | yes | yes |
| NCU06607 | yes | yes | yes | cuffdiff | yes |
| NCU08756 | yes | yes | yes | | yes |
| NCU08790 | yes | yes | yes | | yes |
| NCU09295 | yes | yes | cuffdiff | yes | |
| NCU09524 | yes | yes | yes | yes | yes |
| NCU11268 | yes | yes | cuffdiff | yes | yes |
| NCU11542 | yes | yes | yes | yes | yes |
| NCU11753 | cuffdiff | yes | yes | | cuffdiff |
| NCU00175 | yes | yes | yes | yes | yes |
| NCU00250 | yes | yes | cuffdiff | yes | yes |
| NCU00322 | cuffdiff | yes | cuffdiff | cuffdiff | cuffdiff |
| NCU00695 | cuffdiff | yes | yes | yes | yes |
| NCU07311 | yes | yes | yes | yes | yes |
| NCU08171 | yes | yes | cuffdiff | cuffdiff | cuffdiff |
| NCU08521 | yes | | | yes | cuffdiff |
| NCU10507 | yes | cuffdiff | yes | yes | |
| NCU07143 | yes | yes | | cuffdiff | yes |
| NCU07222 | yes | yes | yes | yes | cuffdiff |
| NCU08371 | yes | cuffdiff | cuffdiff | yes | yes |
| NCU09506 | yes | cuffdiff | yes | yes | yes |
| NCU04106 | yes | cuffdiff | cuffdiff | | yes |
| NCU06526 | yes | cuffdiff | cuffdiff | yes | yes |
| NCU09196 | yes | | cuffdiff | yes | yes |
| NCU11466 | yes | cuffdiff | yes | yes | yes |
| NCU11957 | yes | | | yes | cuffdiff |
| NCU00995 | cuffdiff | yes | yes | yes | cuffdiff |
| NCU01720 | yes | | | yes | yes |
| NCU03293 | yes | cuffdiff | cuffdiff | yes | yes |
| NCU04169 | yes | cuffdiff | cuffdiff | yes | yes |
| NCU04170 | yes | cuffdiff | cuffdiff | yes | yes |
| NCU04467 | yes | | cuffdiff | | yes |
| NCU04932 | yes | cuffdiff | cuffdiff | cuffdiff | cuffdiff |
| NCU04998 | yes | | | | cuffdiff |
| NCU05134 | yes | cuffdiff | cuffdiff | yes | cuffdiff |
| NCU05350 | yes | cuffdiff | | yes | yes |
| NCU05829 | yes | | | yes | yes |
| NCU05852 | yes | | | yes | yes |
| NCU05908 | yes | | cuffdiff | | yes |
| NCU06143 | yes | cuffdiff | cuffdiff | yes | yes |
| NCU06983 | yes | cuffdiff | cuffdiff | yes | |
| NCU06991 | yes | | | yes | |
| NCU08635 | yes | | | yes | yes |
| NCU09046 | cuffdiff | yes | cuffdiff | yes | cuffdiff |
| NCU09172 | yes | | | | yes |
| NCU09424 | yes | | | yes | yes |
| NCU09498 | yes | cuffdiff | cuffdiff | yes | cuffdiff |
| NCU09823 | yes | yes | cuffdiff | cuffdiff | yes |
| NCU09848 | yes | | | yes | cuffdiff |
| NCU10014 | yes | cuffdiff | cuffdiff | yes | cuffdiff |
| NCU10039 | yes | cuffdiff | cuffdiff | yes | yes |
| NCU10687 | yes | | | yes | cuffdiff |
| NCU00561 | yes | cuffdiff | cuffdiff | yes | yes |
| NCU00859 | yes | cuffdiff | | yes | yes |
| NCU02042 | cuffdiff | yes | cuffdiff | cuffdiff | cuffdiff |
| NCU02164 | yes | cuffdiff | cuffdiff | yes | cuffdiff |
| NCU04482 | yes | | | yes | |
| NCU04486 | yes | | | yes | yes |
| NCU05236 | yes | | | yes | yes |
| NCU05761 | yes | | | yes | |
| NCU05763 | yes | | | yes | |
| NCU06328 | yes | cuffdiff | cuffdiff | yes | cuffdiff |
| NCU07948 | yes | | | yes | yes |
| NCU08140 | yes | | | yes | |
| NCU08447 | yes | | | yes | yes |
| NCU09734 | yes | | | yes | |
| NCU12011 | yes | | | yes | cuffdiff |
| NCU00408 | cuffdiff | yes | yes | yes | cuffdiff |
| NCU00633 | yes | yes | cuffdiff | yes | cuffdiff |
| NCU00870 | yes | yes | yes | cuffdiff | yes |
| NCU00871 | yes | yes | yes | cuffdiff | yes |
| NCU00965 | yes | yes | yes | | yes |
| NCU01003 | yes | cuffdiff | cuffdiff | cuffdiff | cuffdiff |
| NCU01049 | yes | yes | yes | | yes |
| NCU01077 | yes | yes | yes | | yes |
| NCU01148 | yes | yes | yes | | yes |
| NCU01944 | yes | yes | yes | yes | yes |
| NCU01970 | cuffdiff | yes | yes | yes | yes |
| NCU01983 | yes | yes | yes | yes | yes |
| NCU02008 | cuffdiff | yes | yes | | yes |
| NCU02061 | yes | yes | yes | | cuffdiff |
| NCU02600 | yes | yes | yes | | yes |
| NCU02625 | yes | yes | yes | cuffdiff | yes |
| NCU02720 | cuffdiff | yes | cuffdiff | yes | cuffdiff |
| NCU02915 | yes | yes | yes | yes | yes |
| NCU03152 | yes | yes | yes | | |
| NCU03329 | yes | yes | yes | yes | yes |
| NCU03433 | yes | yes | yes | | cuffdiff |
| NCU04127 | yes | yes | yes | cuffdiff | cuffdiff |
| NCU04522 | yes | yes | yes | cuffdiff | yes |
| NCU04830 | yes | cuffdiff | cuffdiff | yes | yes |
| NCU04905 | yes | cuffdiff | yes | | |
| NCU05056 | yes | yes | yes | | yes |
| NCU05170 | yes | cuffdiff | yes | | cuffdiff |
| NCU05569 | cuffdiff | yes | yes | cuffdiff | |
| NCU05574 | yes | yes | yes | yes | yes |
| NCU05846 | yes | yes | yes | yes | yes |
| NCU05848 | yes | yes | yes | cuffdiff | yes |
| NCU05854 | yes | cuffdiff | cuffdiff | yes | yes |
| NCU06214 | cuffdiff | cuffdiff | cuffdiff | cuffdiff | cuffdiff |
| NCU06312 | cuffdiff | cuffdiff | cuffdiff | yes | yes |
| NCU06704 | yes | yes | yes | cuffdiff | cuffdiff |

TABLE 1D-continued

Differential expression (DE) patterns between various mutant strains and growth conditions*

| Gene | Avicel v No Carbon DE | Avicel v Δclr-1 DE | Avicel v Δclr-2 DE | Sucrose v No Carbon DE | Avicel v Sucrose DE |
|---|---|---|---|---|---|
| NCU07207 | cuffdiff | yes | yes | yes | yes |
| NCU07336 | yes | yes | yes | | yes |
| NCU07339 | yes | yes | yes | yes | yes |
| NCU07453 | yes | yes | yes | yes | yes |
| NCU07897 | yes | yes | yes | cuffdiff | yes |
| NCU07979 | yes | yes | yes | yes | yes |
| NCU08043 | yes | yes | yes | yes | |
| NCU08113 | yes | yes | yes | | yes |
| NCU08117 | yes | yes | yes | cuffdiff | cuffdiff |
| NCU08379 | yes | yes | yes | cuffdiff | cuffdiff |
| NCU08624 | yes | yes | yes | cuffdiff | yes |
| NCU08784 | yes | yes | cuffdiff | yes | yes |
| NCU09003 | yes | cuffdiff | cuffdiff | yes | cuffdiff |
| NCU09426 | yes | yes | cuffdiff | yes | yes |
| NCU09479 | cuffdiff | cuffdiff | yes | | yes |
| NCU09522 | yes | yes | yes | cuffdiff | cuffdiff |
| NCU09523 | yes | yes | yes | | yes |
| NCU09689 | yes | yes | yes | yes | yes |
| NCU10521 | yes | yes | yes | | cuffdiff |
| NCU11118 | yes | yes | yes | cuffdiff | |
| NCU11278 | yes | yes | yes | yes | yes |
| NCU11327 | cuffdiff | cuffdiff | yes | | cuffdiff |
| NCU11397 | yes | yes | yes | yes | yes |
| NCU11690 | yes | yes | yes | cuffdiff | yes |
| NCU11722 | yes | yes | yes | yes | cuffdiff |
| NCU11862 | cuffdiff | yes | yes | yes | yes |
| NCU00247 | cuffdiff | yes | cuffdiff | yes | cuffdiff |
| NCU01347 | cuffdiff | yes | cuffdiff | cuffdiff | |
| NCU01598 | yes | yes | | yes | yes |
| NCU03761 | cuffdiff | yes | cuffdiff | cuffdiff | cuffdiff |
| NCU04635 | cuffdiff | yes | cuffdiff | yes | cuffdiff |
| NCU04667 | cuffdiff | yes | cuffdiff | yes | yes |
| NCU05058 | yes | yes | yes | | cuffdiff |
| NCU05128 | cuffdiff | yes | yes | yes | yes |
| NCU06265 | yes | cuffdiff | cuffdiff | yes | yes |
| NCU06615 | yes | yes | cuffdiff | yes | yes |
| NCU06895 | cuffdiff | yes | yes | yes | yes |
| NCU07233 | cuffdiff | yes | cuffdiff | cuffdiff | cuffdiff |
| NCU07423 | cuffdiff | yes | cuffdiff | cuffdiff | cuffdiff |
| NCU07424 | yes | cuffdiff | cuffdiff | yes | yes |
| NCU07895 | cuffdiff | yes | cuffdiff | yes | cuffdiff |
| NCU08418 | cuffdiff | yes | cuffdiff | cuffdiff | cuffdiff |
| NCU08557 | yes | | | yes | cuffdiff |
| NCU08712 | cuffdiff | yes | cuffdiff | cuffdiff | cuffdiff |
| NCU09060 | yes | yes | | yes | |
| NCU09231 | cuffdiff | yes | yes | yes | yes |
| NCU09685 | cuffdiff | yes | | yes | yes |
| NCU09958 | cuffdiff | yes | yes | yes | cuffdiff |
| NCU10276 | cuffdiff | yes | yes | cuffdiff | cuffdiff |
| NCU11697 | cuffdiff | yes | yes | yes | cuffdiff |
| NCU11944 | yes | cuffdiff | yes | yes | yes |
| NCU12051 | yes | cuffdiff | yes | yes | yes |
| NCU12128 | yes | cuffdiff | yes | yes | yes |
| NCU12145 | yes | yes | yes | yes | yes |
| NCU00289 | yes | cuffdiff | cuffdiff | cuffdiff | cuffdiff |
| NCU00496 | yes | | | yes | |
| NCU00763 | yes | yes | yes | cuffdiff | yes |
| NCU01386 | yes | cuffdiff | cuffdiff | cuffdiff | cuffdiff |
| NCU02485 | yes | cuffdiff | cuffdiff | | yes |
| NCU02882 | yes | yes | cuffdiff | yes | yes |
| NCU04618 | yes | | | | yes |
| NCU04871 | yes | yes | yes | | yes |
| NCU04904 | yes | cuffdiff | cuffdiff | cuffdiff | yes |
| NCU05351 | yes | | cuffdiff | | yes |
| NCU05501 | yes | yes | yes | yes | yes |
| NCU05906 | yes | cuffdiff | cuffdiff | yes | yes |
| NCU06373 | yes | yes | yes | yes | yes |
| NCU07270 | yes | cuffdiff | cuffdiff | | yes |
| NCU08116 | yes | | | | yes |
| NCU08397 | yes | cuffdiff | cuffdiff | cuffdiff | yes |
| NCU08748 | yes | cuffdiff | cuffdiff | | cuffdiff |
| NCU08867 | yes | yes | yes | yes | cuffdiff |
| NCU09176 | yes | cuffdiff | cuffdiff | yes | yes |
| NCU11769 | yes | | | | yes |
| NCU11828 | yes | yes | yes | yes | |
| NCU11905 | yes | | cuffdiff | | yes |
| NCU00011 | yes | | | yes | cuffdiff |
| NCU00397 | yes | cuffdiff | cuffdiff | yes | cuffdiff |
| NCU00510 | yes | | | yes | cuffdiff |
| NCU00935 | yes | cuffdiff | cuffdiff | | yes |
| NCU01880 | yes | | | yes | yes |
| NCU02080 | yes | cuffdiff | cuffdiff | cuffdiff | cuffdiff |
| NCU02130 | yes | cuffdiff | cuffdiff | yes | yes |
| NCU02163 | yes | cuffdiff | cuffdiff | yes | cuffdiff |
| NCU02365 | yes | | | yes | cuffdiff |
| NCU03157 | yes | | | yes | cuffdiff |
| NCU03352 | yes | cuffdiff | cuffdiff | | cuffdiff |
| NCU03398 | yes | cuffdiff | cuffdiff | yes | yes |
| NCU03570 | yes | | | yes | |
| NCU04282 | yes | cuffdiff | cuffdiff | yes | yes |
| NCU04342 | yes | cuffdiff | cuffdiff | cuffdiff | |
| NCU04360 | yes | cuffdiff | cuffdiff | cuffdiff | cuffdiff |
| NCU04525 | yes | cuffdiff | cuffdiff | cuffdiff | cuffdiff |
| NCU04866 | yes | yes | cuffdiff | yes | |
| NCU05784 | yes | cuffdiff | cuffdiff | yes | yes |
| NCU05951 | yes | | | yes | yes |
| NCU05976 | yes | | | | yes |
| NCU06156 | yes | cuffdiff | cuffdiff | yes | yes |
| NCU06986 | yes | cuffdiff | cuffdiff | yes | cuffdiff |
| NCU07126 | yes | cuffdiff | | cuffdiff | cuffdiff |
| NCU07593 | yes | | | yes | cuffdiff |
| NCU07718 | yes | yes | yes | yes | yes |
| NCU08224 | yes | cuffdiff | cuffdiff | yes | |
| NCU08469 | yes | yes | yes | yes | yes |
| NCU08726 | yes | cuffdiff | cuffdiff | yes | cuffdiff |
| NCU09049 | yes | | | yes | yes |
| NCU09115 | yes | cuffdiff | cuffdiff | yes | yes |
| NCU09883 | yes | cuffdiff | cuffdiff | yes | cuffdiff |
| NCU10658 | yes | cuffdiff | cuffdiff | yes | |
| NCU10770 | yes | | | cuffdiff | |
| NCU11294 | yes | cuffdiff | | cuffdiff | |
| NCU00304 | yes | cuffdiff | | cuffdiff | cuffdiff |
| NCU00798 | yes | | | yes | cuffdiff |
| NCU01136 | yes | | | yes | |
| NCU01430 | yes | cuffdiff | cuffdiff | yes | yes |
| NCU03791 | yes | | | yes | yes |
| NCU04167 | yes | yes | cuffdiff | yes | yes |
| NCU04400 | yes | cuffdiff | cuffdiff | yes | yes |
| NCU04557 | yes | | | | yes |
| NCU04879 | cuffdiff | yes | | cuffdiff | |
| NCU04910 | yes | | cuffdiff | cuffdiff | yes |
| NCU04928 | yes | | | yes | |
| NCU05068 | yes | cuffdiff | cuffdiff | | yes |
| NCU05755 | yes | cuffdiff | cuffdiff | yes | yes |
| NCU05826 | yes | | | yes | yes |
| NCU05832 | yes | cuffdiff | cuffdiff | cuffdiff | cuffdiff |
| NCU05875 | yes | | | yes | yes |
| NCU05909 | yes | | cuffdiff | | yes |
| NCU06181 | yes | | | yes | |
| NCU06235 | yes | | | yes | yes |
| NCU06387 | yes | cuffdiff | cuffdiff | cuffdiff | yes |
| NCU07235 | cuffdiff | yes | yes | cuffdiff | |
| NCU07510 | yes | | cuffdiff | | yes |
| NCU07572 | cuffdiff | yes | cuffdiff | | cuffdiff |
| NCU07997 | yes | cuffdiff | | cuffdiff | yes |
| NCU08383 | yes | | | cuffdiff | yes |
| NCU08491 | cuffdiff | yes | cuffdiff | yes | yes |
| NCU08634 | yes | | | yes | yes |
| NCU09075 | cuffdiff | yes | | cuffdiff | |
| NCU09415 | yes | cuffdiff | cuffdiff | yes | cuffdiff |
| NCU09856 | yes | | | yes | yes |
| NCU09874 | cuffdiff | yes | cuffdiff | yes | cuffdiff |
| NCU09906 | yes | cuffdiff | cuffdiff | | cuffdiff |
| NCU10284 | yes | | cuffdiff | yes | cuffdiff |
| NCU10697 | yes | cuffdiff | | | |
| NCU11095 | yes | | | | yes |

TABLE 1D-continued

Differential expression (DE) patterns between various mutant strains and growth conditions*

| Gene | Avicel v No Carbon DE | Avicel v Δclr-1 DE | Avicel v Δclr-2 DE | Sucrose v No Carbon DE | Avicel v Sucrose DE |
|---|---|---|---|---|---|
| NCU11291 | yes | cuffdiff | cuffdiff | | cuffdiff |
| NCU11689 | cuffdiff | yes | yes | | cuffdiff |
| NCU11801 | yes | | | | cuffdiff |
| NCU11932 | yes | cuffdiff | | yes | yes |
| NCU00365 | yes | | | cuffdiff | cuffdiff |
| NCU00375 | yes | | | yes | yes |
| NCU00755 | yes | | | yes | yes |
| NCU01109 | yes | | | yes | yes |
| NCU01292 | yes | | | yes | |
| NCU01551 | yes | | | yes | cuffdiff |
| NCU01649 | yes | cuffdiff | cuffdiff | cuffdiff | cuffdiff |
| NCU03011 | yes | | | yes | |
| NCU03417 | yes | cuffdiff | | yes | |
| NCU04285 | yes | | | yes | |
| NCU04843 | yes | cuffdiff | cuffdiff | yes | cuffdiff |
| NCU04851 | yes | | | yes | |
| NCU04861 | yes | | | yes | yes |
| NCU04862 | yes | cuffdiff | cuffdiff | yes | cuffdiff |
| NCU05006 | yes | | | yes | cuffdiff |
| NCU05189 | yes | | | yes | |
| NCU05197 | yes | cuffdiff | cuffdiff | cuffdiff | cuffdiff |
| NCU05477 | yes | | | yes | |
| NCU05762 | yes | | | yes | |
| NCU05764 | yes | | | yes | |
| NCU05766 | yes | | | yes | yes |
| NCU05859 | yes | | | yes | |
| NCU05933 | yes | | | yes | yes |
| NCU06334 | yes | | | yes | yes |
| NCU07180 | yes | | | yes | yes |
| NCU07363 | yes | cuffdiff | cuffdiff | yes | cuffdiff |
| NCU08037 | yes | | cuffdiff | yes | yes |
| NCU08155 | yes | cuffdiff | | yes | cuffdiff |
| NCU08156 | yes | | | yes | yes |
| NCU08170 | yes | | | yes | |
| NCU08455 | yes | cuffdiff | cuffdiff | yes | yes |
| NCU08554 | yes | cuffdiff | cuffdiff | yes | cuffdiff |
| NCU08622 | yes | | | yes | |
| NCU08700 | yes | | | yes | cuffdiff |
| NCU08775 | yes | | | yes | yes |
| NCU09272 | yes | | | yes | yes |
| NCU09273 | yes | | | yes | cuffdiff |
| NCU09274 | yes | | | yes | cuffdiff |
| NCU09335 | yes | | cuffdiff | yes | yes |
| NCU09342 | yes | | | yes | |
| NCU09714 | yes | cuffdiff | | yes | yes |
| NCU09782 | yes | | cuffdiff | yes | cuffdiff |
| NCU10062 | yes | | cuffdiff | | cuffdiff |
| NCU10301 | yes | | | yes | yes |
| NCU11565 | yes | | | yes | cuffdiff |
| NCU11774 | yes | cuffdiff | | yes | yes |
| NCU11881 | yes | cuffdiff | | yes | cuffdiff |
| NCU11974 | yes | cuffdiff | cuffdiff | yes | cuffdiff |
| NCU11989 | yes | cuffdiff | cuffdiff | yes | yes |
| NCU12012 | yes | | | yes | |
| NCU12014 | yes | | | yes | |
| NCU12015 | yes | | | yes | |

TABLE 1E

Differential expression (DE) between various conditions, continued*

| Gene | Sucrose V Both Mutants DE | No Carbon v Both Mutants DE | Δclr-1 v Δclr-2 DE |
|---|---|---|---|
| NCU00554 | cuffdiff | | |
| NCU00944 | | | |
| NCU01195 | cuffdiff | cuffdiff | |
| NCU02785 | cuffdiff | | |
| NCU02954 | cuffdiff | | |
| NCU03131 | cuffdiff | | |
| NCU04216 | cuffdiff | | |
| NCU04298 | | | |
| NCU04837 | cuffdiff | | |
| NCU05548 | cuffdiff | cuffdiff | |
| NCU07413 | cuffdiff | cuffdiff | |
| NCU10283 | | | |
| NCU00461 | cuffdiff | cuffdiff | yes |
| NCU00591 | | cuffdiff | cuffdiff |
| NCU00680 | cuffdiff | | |
| NCU01402 | | yes | |
| NCU02127 | cuffdiff | cuffdiff | cuffdiff |
| NCU02704 | | cuffdiff | yes |
| NCU02727 | cuffdiff | cuffdiff | yes |
| NCU02936 | | cuffdiff | yes |
| NCU03076 | cuffdiff | cuffdiff | cuffdiff |
| NCU03415 | | cuffdiff | cuffdiff |
| NCU03648 | | cuffdiff | cuffdiff |
| NCU03913 | | cuffdiff | yes |
| NCU05499 | | cuffdiff | cuffdiff |
| NCU05537 | cuffdiff | cuffdiff | cuffdiff |
| NCU05977 | | cuffdiff | cuffdiff |
| NCU06448 | cuffdiff | cuffdiff | cuffdiff |
| NCU06543 | | cuffdiff | cuffdiff |
| NCU07153 | cuffdiff | cuffdiff | cuffdiff |
| NCU08216 | cuffdiff | cuffdiff | cuffdiff |
| NCU09116 | | cuffdiff | cuffdiff |
| NCU09266 | cuffdiff | cuffdiff | cuffdiff |
| NCU09864 | cuffdiff | cuffdiff | cuffdiff |
| NCU11195 | cuffdiff | cuffdiff | cuffdiff |
| NCU01830 | | yes | cuffdiff |
| NCU02126 | | cuffdiff | cuffdiff |
| NCU01744 | cuffdiff | cuffdiff | cuffdiff |
| NCU03748 | cuffdiff | cuffdiff | |
| NCU06625 | cuffdiff | yes | |
| NCU04130 | cuffdiff | cuffdiff | yes |
| NCU10110 | | yes | cuffdiff |
| NCU03861 | | yes | |
| NCU07623 | | yes | |
| NCU01427 | cuffdiff | yes | |
| NCU03651 | cuffdiff | cuffdiff | yes |
| NCU02579 | cuffdiff | cuffdiff | |
| NCU07307 | | yes | |
| NCU07308 | cuffdiff | yes | |
| NCU05858 | | yes | |
| NCU01013 | | | |
| NCU06189 | cuffdiff | | |
| NCU05165 | cuffdiff | cuffdiff | yes |
| NCU04865 | cuffdiff | yes | |
| NCU05011 | | yes | |
| NCU00762 | cuffdiff | | |
| NCU00836 | | | |
| NCU01050 | cuffdiff | cuffdiff | cuffdiff |
| NCU02240 | | | |
| NCU02344 | | | |
| NCU02916 | | | |
| NCU03328 | | | |
| NCU04854 | | | |
| NCU05057 | | | |
| NCU05121 | | | |
| NCU07190 | | cuffdiff | yes |
| NCU07340 | cuffdiff | | |
| NCU07760 | yes | | |
| NCU07898 | cuffdiff | | |
| NCU08760 | | | |
| NCU09680 | | | |
| NCU03322 | | yes | cuffdiff |
| NCU07362 | cuffdiff | cuffdiff | |
| NCU03813 | | cuffdiff | cuffdiff |
| NCU04539 | | cuffdiff | |
| NCU08687 | cuffdiff | cuffdiff | |
| NCU05133 | cuffdiff | yes | cuffdiff |
| NCU09705 | | yes | cuffdiff |
| NCU07277 | cuffdiff | yes | |

TABLE 1E-continued

Differential expression (DE) between various conditions, continued*

| Gene | Sucrose V Both Mutants DE | No Carbon v Both Mutants DE | Δclr-1 v Δclr-2 DE |
|---|---|---|---|
| NCU04797 | cuffdiff | cuffdiff | yes |
| NCU00575 | cuffdiff | cuffdiff | |
| NCU04401 | | yes | cuffdiff |
| NCU02855 | | yes | |
| NCU05924 | cuffdiff | | |
| NCU05955 | | | |
| NCU07326 | | | |
| NCU09775 | | | |
| NCU04997 | | | |
| NCU01900 | | yes | cuffdiff |
| NCU02343 | | yes | cuffdiff |
| NCU07225 | cuffdiff | yes | cuffdiff |
| NCU08087 | yes | yes | |
| NCU08189 | cuffdiff | yes | cuffdiff |
| NCU09652 | | yes | cuffdiff |
| NCU06881 | | cuffdiff | cuffdiff |
| NCU01853 | | | |
| NCU02287 | | cuffdiff | cuffdiff |
| NCU02894 | | cuffdiff | |
| NCU07263 | cuffdiff | | yes |
| NCU08924 | cuffdiff | cuffdiff | cuffdiff |
| NCU09692 | yes | cuffdiff | |
| NCU04796 | | cuffdiff | |
| NCU09732 | cuffdiff | cuffdiff | yes |
| NCU07719 | | cuffdiff | |
| NCU12093 | | cuffdiff | |
| NCU05818 | | yes | |
| NCU04078 | | cuffdiff | yes |
| NCU07617 | | yes | |
| NCU08398 | cuffdiff | | yes |
| NCU10683 | | | |
| NCU10063 | | yes | |
| NCU04933 | cuffdiff | yes | |
| NCU00890 | | cuffdiff | yes |
| NCU04623 | | | cuffdiff |
| NCU04952 | | cuffdiff | |
| NCU05956 | | | |
| NCU07487 | | | |
| NCU08755 | | cuffdiff | yes |
| NCU00130 | | yes | yes |
| NCU00709 | | yes | |
| NCU04168 | | yes | cuffdiff |
| NCU09904 | yes | yes | |
| NCU09923 | | yes | |
| NCU03098 | | yes | |
| NCU09028 | | yes | |
| NCU09281 | | yes | |
| NCU10107 | | yes | cuffdiff |
| NCU00206 | | | |
| NCU00710 | | yes | |
| NCU01059 | | | yes |
| NCU03181 | | | |
| NCU04494 | | | |
| NCU05598 | cuffdiff | | |
| NCU05751 | | | |
| NCU08176 | | | |
| NCU08746 | | | yes |
| NCU08785 | cuffdiff | yes | |
| NCU09445 | | cuffdiff | cuffdiff |
| NCU09491 | | | |
| NCU09582 | | yes | |
| NCU09764 | | | |
| NCU09774 | | | |
| NCU09976 | | | |
| NCU10045 | | yes | |
| NCU11068 | | cuffdiff | yes |
| NCU11198 | | | |
| NCU02904 | cuffdiff | | |
| NCU04870 | cuffdiff | yes | |
| NCU05159 | | yes | cuffdiff |
| NCU09518 | | | |
| NCU09664 | | cuffdiff | |
| NCU09924 | | yes | |
| NCU03158 | | cuffdiff | |
| NCU07067 | | yes | |
| NCU01353 | cuffdiff | yes | |
| NCU07269 | | yes | |
| NCU06023 | | cuffdiff | |
| NCU06025 | | yes | |
| NCU00761 | | | |
| NCU06650 | yes | yes | cuffdiff |
| NCU09416 | cuffdiff | cuffdiff | |
| NCU00292 | | yes | cuffdiff |
| NCU03903 | | yes | |
| NCU04475 | | yes | cuffdiff |
| NCU06364 | | yes | cuffdiff |
| NCU09575 | | yes | |
| NCU04230 | cuffdiff | cuffdiff | yes |
| NCU02366 | cuffdiff | yes | |
| NCU04280 | cuffdiff | yes | |
| NCU04385 | cuffdiff | yes | |
| NCU02969 | | yes | |
| NCU08164 | cuffdiff | cuffdiff | |
| NCU00891 | cuffdiff | yes | cuffdiff |
| NCU08384 | | yes | cuffdiff |
| NCU08272 | | | cuffdiff |
| NCU07619 | | | |
| NCU05304 | cuffdiff | | |
| NCU01510 | yes | cuffdiff | |
| NCU05768 | | yes | cuffdiff |
| NCU07154 | | cuffdiff | cuffdiff |
| NCU01998 | cuffdiff | cuffdiff | |
| NCU08457 | yes | yes | cuffdiff |
| NCU06386 | | | |
| NCU09425 | | cuffdiff | cuffdiff |
| NCU02478 | cuffdiff | cuffdiff | cuffdiff |
| NCU09175 | cuffdiff | cuffdiff | cuffdiff |
| NCU01689 | | cuffdiff | cuffdiff |
| NCU11721 | cuffdiff | | |
| NCU02396 | cuffdiff | | cuffdiff |
| NCU07481 | | | |
| NCU03137 | | | |
| NCU02500 | yes | yes | |
| NCU00565 | cuffdiff | cuffdiff | cuffdiff |
| NCU02705 | cuffdiff | cuffdiff | cuffdiff |
| NCU05225 | cuffdiff | cuffdiff | |
| NCU08326 | | | yes |
| NCU00326 | cuffdiff | | yes |
| NCU08691 | | yes | |
| NCU09043 | yes | cuffdiff | |
| NCU07432 | cuffdiff | cuffdiff | |
| NCU05841 | | yes | |
| NCU02361 | cuffdiff | cuffdiff | cuffdiff |
| NCU10051 | cuffdiff | yes | yes |
| NCU04720 | cuffdiff | yes | cuffdiff |
| NCU04698 | cuffdiff | cuffdiff | cuffdiff |
| NCU00177 | cuffdiff | | |
| NCU01786 | cuffdiff | | |
| NCU03117 | cuffdiff | cuffdiff | |
| NCU05254 | cuffdiff | | |
| NCU03963 | cuffdiff | | yes |
| NCU09659 | cuffdiff | cuffdiff | yes |
| NCU03488 | cuffdiff | yes | |
| NCU02657 | cuffdiff | | |
| NCU05855 | | yes | |
| NCU08044 | cuffdiff | cuffdiff | cuffdiff |
| NCU09283 | cuffdiff | cuffdiff | cuffdiff |
| NCU11243 | | cuffdiff | |
| NCU01378 | cuffdiff | cuffdiff | |
| NCU01861 | cuffdiff | cuffdiff | cuffdiff |
| NCU04583 | cuffdiff | yes | |
| NCU06616 | cuffdiff | cuffdiff | yes |
| NCU07325 | | cuffdiff | |
| NCU08771 | | cuffdiff | cuffdiff |
| NCU09553 | | cuffdiff | cuffdiff |
| NCU10055 | | | |
| NCU11289 | | | |
| NCU08750 | cuffdiff | yes | cuffdiff |

TABLE 1E-continued

Differential expression (DE) between various conditions, continued*

| Gene | Sucrose V Both Mutants DE | No Carbon v Both Mutants DE | Δclr-1 v Δclr-2 DE |
|---|---|---|---|
| NCU08752 | | yes | yes |
| NCU03049 | | cuffdiff | |
| NCU05653 | | cuffdiff | |
| NCU07133 | | cuffdiff | cuffdiff |
| NCU08925 | | cuffdiff | |
| NCU09865 | | | |
| NCU11365 | cuffdiff | cuffdiff | |
| NCU07055 | cuffdiff | yes | |
| NCU07224 | | yes | |
| NCU01061 | cuffdiff | yes | |
| NCU03566 | | cuffdiff | |
| NCU04260 | | yes | |
| NCU05094 | | yes | |
| NCU05986 | | cuffdiff | |
| NCU06153 | | yes | |
| NCU09674 | cuffdiff | yes | |
| NCU11241 | cuffdiff | yes | |
| NCU03013 | cuffdiff | yes | cuffdiff |
| NCU05319 | cuffdiff | | |
| NCU04430 | | yes | yes |
| NCU02059 | yes | cuffdiff | |
| NCU00831 | cuffdiff | cuffdiff | cuffdiff |
| NCU06055 | | cuffdiff | |
| NCU00263 | cuffdiff | yes | yes |
| NCU07200 | cuffdiff | yes | yes |
| NCU09992 | | yes | yes |
| NCU09265 | cuffdiff | cuffdiff | cuffdiff |
| NCU00813 | cuffdiff | | |
| NCU02455 | cuffdiff | cuffdiff | cuffdiff |
| NCU09223 | cuffdiff | cuffdiff | |
| NCU09485 | | cuffdiff | |
| NCU01648 | cuffdiff | cuffdiff | |
| NCU10497 | | | cuffdiff |
| NCU00669 | | | |
| NCU02118 | | | |
| NCU10762 | | | |
| NCU00244 | cuffdiff | cuffdiff | |
| NCU01068 | cuffdiff | cuffdiff | |
| NCU03319 | cuffdiff | cuffdiff | |
| NCU08761 | | | |
| NCU01279 | cuffdiff | cuffdiff | |
| NCU03819 | | cuffdiff | |
| NCU08607 | cuffdiff | cuffdiff | |
| NCU09195 | | cuffdiff | |
| NCU07736 | cuffdiff | yes | cuffdiff |
| NCU01290 | cuffdiff | | |
| NCU03396 | cuffdiff | | |
| NCU09521 | cuffdiff | | |
| NCU03897 | | | |
| NCU07746 | cuffdiff | | |
| NCU08897 | | cuffdiff | |
| NCU00169 | | cuffdiff | |
| NCU02681 | cuffdiff | | |
| NCU06333 | | | |
| NCU01146 | | cuffdiff | |
| NCU00931 | cuffdiff | | |
| NCU07008 | | yes | |
| NCU03295 | | cuffdiff | cuffdiff |
| NCU07737 | cuffdiff | yes | cuffdiff |
| NCU08038 | | cuffdiff | |
| NCU02729 | cuffdiff | | |
| NCU03364 | | cuffdiff | |
| NCU03817 | | yes | |
| NCU06111 | cuffdiff | yes | |
| NCU08115 | | yes | cuffdiff |
| NCU06931 | | | |
| NCU04077 | cuffdiff | cuffdiff | |
| NCU01862 | | cuffdiff | |
| NCU02795 | | cuffdiff | |
| NCU00812 | cuffdiff | | cuffdiff |
| NCU01856 | cuffdiff | cuffdiff | |
| NCU03725 | cuffdiff | cuffdiff | |
| NCU06971 | | | cuffdiff |
| NCU07705 | | cuffdiff | yes |
| NCU08042 | | | yes |
| NCU03643 | | cuffdiff | |
| NCU03043 | cuffdiff | cuffdiff | cuffdiff |
| NCU05767 | | yes | |
| NCU00316 | | | cuffdiff |
| NCU00721 | cuffdiff | yes | |
| NCU07578 | cuffdiff | cuffdiff | |
| NCU04435 | | | |
| NCU05198 | | cuffdiff | |
| NCU10721 | | | |
| NCU11342 | | | |
| NCU00821 | | cuffdiff | cuffdiff |
| NCU08561 | | cuffdiff | yes |
| NCU09287 | | cuffdiff | cuffdiff |
| NCU00801 | | yes | cuffdiff |
| NCU00809 | | cuffdiff | |
| NCU07668 | | yes | |
| NCU05089 | | yes | |
| NCU08152 | | yes | |
| NCU01633 | cuffdiff | yes | cuffdiff |
| NCU04537 | | yes | |
| NCU05853 | | yes | yes |
| NCU08114 | cuffdiff | yes | yes |
| NCU00023 | | cuffdiff | |
| NCU02009 | yes | cuffdiff | |
| NCU07068 | | cuffdiff | |
| NCU03305 | | cuffdiff | |
| NCU08225 | cuffdiff | cuffdiff | |
| NCU08147 | yes | cuffdiff | |
| NCU06366 | cuffdiff | cuffdiff | |
| NCU05585 | | cuffdiff | cuffdiff |
| NCU06138 | | yes | cuffdiff |
| NCU05591 | | yes | cuffdiff |
| NCU06032 | | | |
| NCU09098 | cuffdiff | | |
| NCU10009 | | | |
| NCU00290 | | cuffdiff | cuffdiff |
| NCU09580 | | | |
| NCU00803 | | yes | |
| NCU04374 | | yes | |
| NCU08425 | | yes | |
| NCU04097 | cuffdiff | | cuffdiff |
| NCU05079 | cuffdiff | yes | cuffdiff |
| NCU07546 | | yes | |
| NCU08148 | cuffdiff | yes | yes |
| NCU03107 | | yes | |
| NCU00586 | cuffdiff | cuffdiff | |
| NCU00716 | cuffdiff | | yes |
| NCU00025 | cuffdiff | cuffdiff | |
| NCU00848 | cuffdiff | yes | |
| NCU00449 | cuffdiff | cuffdiff | cuffdiff |
| NCU00849 | | yes | yes |
| NCU01058 | | | |
| NCU01076 | | | |
| NCU01196 | | | |
| NCU01978 | | | |
| NCU02138 | cuffdiff | yes | |
| NCU03083 | | cuffdiff | |
| NCU03982 | cuffdiff | cuffdiff | |
| NCU04948 | cuffdiff | | |
| NCU05230 | | | |
| NCU05863 | | cuffdiff | yes |
| NCU05864 | | cuffdiff | cuffdiff |
| NCU06152 | | | |
| NCU06607 | | | |
| NCU08756 | | cuffdiff | yes |
| NCU08790 | cuffdiff | cuffdiff | yes |
| NCU09295 | cuffdiff | cuffdiff | |
| NCU09524 | | | yes |
| NCU11268 | | | |

TABLE 1E-continued

Differential expression (DE) between various conditions, continued*

| Gene | Sucrose V Both Mutants DE | No Carbon v Both Mutants DE | Δclr-1 v Δclr-2 DE |
|---|---|---|---|
| NCU11542 | | | |
| NCU11753 | yes | | |
| NCU00175 | | cuffdiff | cuffdiff |
| NCU00250 | yes | cuffdiff | |
| NCU00322 | cuffdiff | cuffdiff | cuffdiff |
| NCU00695 | cuffdiff | cuffdiff | cuffdiff |
| NCU07311 | cuffdiff | cuffdiff | |
| NCU08171 | yes | cuffdiff | cuffdiff |
| NCU08521 | | | |
| NCU10507 | | cuffdiff | |
| NCU07143 | | yes | cuffdiff |
| NCU07222 | cuffdiff | yes | |
| NCU08371 | | cuffdiff | |
| NCU09506 | | | |
| NCU04106 | cuffdiff | yes | |
| NCU06526 | | yes | cuffdiff |
| NCU09196 | | cuffdiff | |
| NCU11466 | | cuffdiff | |
| NCU11957 | | | |
| NCU00995 | cuffdiff | yes | yes |
| NCU01720 | cuffdiff | yes | |
| NCU03293 | cuffdiff | yes | cuffdiff |
| NCU04169 | | yes | |
| NCU04170 | | yes | |
| NCU04467 | cuffdiff | yes | cuffdiff |
| NCU04932 | cuffdiff | yes | |
| NCU04998 | | yes | |
| NCU05134 | yes | yes | yes |
| NCU05350 | | yes | cuffdiff |
| NCU05829 | cuffdiff | yes | |
| NCU05852 | | yes | cuffdiff |
| NCU05908 | | cuffdiff | yes |
| NCU06143 | | yes | cuffdiff |
| NCU06983 | | yes | |
| NCU06991 | | yes | |
| NCU08635 | yes | yes | |
| NCU09046 | | yes | |
| NCU09172 | | cuffdiff | |
| NCU09424 | | yes | |
| NCU09498 | cuffdiff | yes | |
| NCU09823 | cuffdiff | yes | cuffdiff |
| NCU09848 | cuffdiff | yes | |
| NCU10014 | cuffdiff | yes | cuffdiff |
| NCU10039 | | yes | |
| NCU10687 | cuffdiff | yes | |
| NCU00561 | | yes | |
| NCU00859 | cuffdiff | yes | cuffdiff |
| NCU02042 | cuffdiff | yes | |
| NCU02164 | cuffdiff | yes | |
| NCU04482 | | yes | |
| NCU04486 | | yes | |
| NCU05236 | | yes | |
| NCU05761 | | yes | |
| NCU05763 | | yes | |
| NCU06328 | cuffdiff | yes | |
| NCU07948 | | yes | |
| NCU08140 | | | |
| NCU08447 | | yes | |
| NCU09734 | | yes | |
| NCU12011 | | yes | |
| NCU00408 | cuffdiff | | |
| NCU00633 | cuffdiff | | cuffdiff |
| NCU00870 | | yes | cuffdiff |
| NCU00871 | | | |
| NCU00965 | | | |
| NCU01003 | | | |
| NCU01049 | | | |
| NCU01077 | | | |
| NCU01148 | | | |
| NCU01944 | | yes | |
| NCU01970 | cuffdiff | cuffdiff | |
| NCU01983 | cuffdiff | | |
| NCU02008 | yes | | cuffdiff |
| NCU02061 | yes | yes | cuffdiff |
| NCU02600 | | | |
| NCU02625 | | | |
| NCU02720 | cuffdiff | | |
| NCU02915 | | cuffdiff | |
| NCU03152 | cuffdiff | | |
| NCU03329 | cuffdiff | cuffdiff | |
| NCU03433 | | | |
| NCU04127 | cuffdiff | | |
| NCU04522 | | cuffdiff | yes |
| NCU04830 | cuffdiff | | |
| NCU04905 | | cuffdiff | |
| NCU05056 | | | |
| NCU05170 | cuffdiff | cuffdiff | cuffdiff |
| NCU05569 | cuffdiff | cuffdiff | |
| NCU05574 | | cuffdiff | yes |
| NCU05846 | | cuffdiff | yes |
| NCU05848 | cuffdiff | cuffdiff | cuffdiff |
| NCU05854 | | | |
| NCU06214 | cuffdiff | cuffdiff | |
| NCU06312 | | | |
| NCU06704 | cuffdiff | cuffdiff | cuffdiff |
| NCU07207 | | | |
| NCU07336 | | | |
| NCU07339 | | | |
| NCU07453 | cuffdiff | | |
| NCU07897 | | | |
| NCU07979 | yes | | |
| NCU08043 | | | |
| NCU08113 | | cuffdiff | yes |
| NCU08117 | | | |
| NCU08379 | cuffdiff | cuffdiff | cuffdiff |
| NCU08624 | | | |
| NCU08784 | | | |
| NCU09003 | | | |
| NCU09426 | | | |
| NCU09479 | | | |
| NCU09522 | | | |
| NCU09523 | | | |
| NCU09689 | | cuffdiff | yes |
| NCU10521 | cuffdiff | | |
| NCU11118 | cuffdiff | | cuffdiff |
| NCU11278 | | | |
| NCU11327 | cuffdiff | | |
| NCU11397 | cuffdiff | | |
| NCU11690 | | | |
| NCU11722 | cuffdiff | | |
| NCU11862 | | cuffdiff | |
| NCU00247 | yes | | cuffdiff |
| NCU01347 | | | cuffdiff |
| NCU01598 | | | |
| NCU03761 | cuffdiff | | yes |
| NCU04635 | yes | cuffdiff | yes |
| NCU04667 | cuffdiff | cuffdiff | |
| NCU05058 | | | |
| NCU05128 | | yes | |
| NCU06265 | yes | cuffdiff | cuffdiff |
| NCU06615 | cuffdiff | cuffdiff | cuffdiff |
| NCU06895 | | cuffdiff | cuffdiff |
| NCU07233 | cuffdiff | cuffdiff | cuffdiff |
| NCU07423 | | | cuffdiff |
| NCU07424 | cuffdiff | cuffdiff | cuffdiff |
| NCU07895 | cuffdiff | cuffdiff | cuffdiff |
| NCU08418 | | cuffdiff | cuffdiff |
| NCU08557 | yes | | |
| NCU08712 | cuffdiff | cuffdiff | cuffdiff |
| NCU09060 | | | yes |
| NCU09231 | | cuffdiff | |
| NCU09685 | | | yes |
| NCU09958 | cuffdiff | cuffdiff | yes |
| NCU10276 | cuffdiff | yes | cuffdiff |
| NCU11697 | | | cuffdiff |
| NCU11944 | | | |
| NCU12051 | | cuffdiff | |
| NCU12128 | | | |

TABLE 1E-continued

Differential expression (DE) between various conditions, continued*

| Gene | Sucrose V Both Mutants DE | No Carbon v Both Mutants DE | Δclr-1 v Δclr-2 DE |
|---|---|---|---|
| NCU12145 | | cuffdiff | |
| NCU00289 | cuffdiff | cuffdiff | cuffdiff |
| NCU00496 | | | |
| NCU00763 | | | |
| NCU01386 | cuffdiff | cuffdiff | cuffdiff |
| NCU02485 | | yes | cuffdiff |
| NCU02882 | | yes | |
| NCU04618 | yes | cuffdiff | |
| NCU04871 | | | |
| NCU04904 | cuffdiff | cuffdiff | |
| NCU05351 | | cuffdiff | |
| NCU05501 | | yes | |
| NCU05906 | | cuffdiff | |
| NCU06373 | | cuffdiff | |
| NCU07270 | | | |
| NCU08116 | | | |
| NCU08397 | cuffdiff | yes | yes |
| NCU08748 | cuffdiff | | |
| NCU08867 | | yes | |
| NCU09176 | yes | yes | cuffdiff |
| NCU11769 | | | |
| NCU11828 | cuffdiff | yes | |
| NCU11905 | | | |
| NCU00011 | | | |
| NCU00397 | cuffdiff | cuffdiff | |
| NCU00510 | | cuffdiff | |
| NCU00935 | cuffdiff | yes | |
| NCU01880 | | cuffdiff | |
| NCU02080 | cuffdiff | cuffdiff | cuffdiff |
| NCU02130 | | cuffdiff | |
| NCU02163 | cuffdiff | yes | cuffdiff |
| NCU02365 | | yes | |
| NCU03157 | | cuffdiff | |
| NCU03352 | cuffdiff | cuffdiff | |
| NCU03398 | | cuffdiff | cuffdiff |
| NCU03570 | | yes | |
| NCU04282 | | yes | |
| NCU04342 | cuffdiff | cuffdiff | cuffdiff |
| NCU04360 | cuffdiff | cuffdiff | |
| NCU04525 | cuffdiff | yes | |
| NCU04866 | cuffdiff | yes | |
| NCU05784 | | yes | |
| NCU05951 | | yes | |
| NCU05976 | | | |
| NCU06156 | cuffdiff | cuffdiff | |
| NCU06986 | | yes | |
| NCU07126 | cuffdiff | cuffdiff | |
| NCU07593 | | | |
| NCU07718 | cuffdiff | yes | |
| NCU08224 | | yes | |
| NCU08469 | | cuffdiff | |
| NCU08726 | | cuffdiff | |
| NCU09049 | | yes | |
| NCU09115 | cuffdiff | cuffdiff | cuffdiff |
| NCU09883 | | cuffdiff | |
| NCU10658 | | cuffdiff | |
| NCU10770 | | | |
| NCU11294 | cuffdiff | cuffdiff | cuffdiff |
| NCU00304 | cuffdiff | yes | cuffdiff |
| NCU00798 | cuffdiff | yes | |
| NCU01136 | cuffdiff | yes | |
| NCU01430 | | yes | |
| NCU03791 | cuffdiff | yes | cuffdiff |
| NCU04167 | | yes | cuffdiff |
| NCU04400 | cuffdiff | yes | cuffdiff |
| NCU04557 | | yes | |
| NCU04879 | cuffdiff | yes | yes |
| NCU04910 | cuffdiff | cuffdiff | cuffdiff |
| NCU04928 | cuffdiff | | |
| NCU05068 | | yes | cuffdiff |
| NCU05755 | | yes | |
| NCU05826 | cuffdiff | yes | |
| NCU05832 | cuffdiff | yes | cuffdiff |
| NCU05875 | | yes | |
| NCU05909 | | yes | |
| NCU06181 | | yes | |
| NCU06235 | cuffdiff | yes | |
| NCU06387 | | yes | |
| NCU07235 | | yes | |
| NCU07510 | | yes | |
| NCU07572 | | yes | cuffdiff |
| NCU07997 | cuffdiff | yes | cuffdiff |
| NCU08383 | | yes | |
| NCU08491 | | cuffdiff | cuffdiff |
| NCU08634 | | yes | |
| NCU09075 | yes | yes | |
| NCU09415 | cuffdiff | yes | |
| NCU09856 | | yes | |
| NCU09874 | cuffdiff | yes | yes |
| NCU09906 | yes | yes | |
| NCU10284 | cuffdiff | yes | cuffdiff |
| NCU10697 | | yes | |
| NCU11095 | | yes | |
| NCU11291 | cuffdiff | yes | |
| NCU11689 | | yes | |
| NCU11801 | | yes | |
| NCU11932 | | yes | cuffdiff |
| NCU00365 | cuffdiff | yes | |
| NCU00375 | | yes | |
| NCU00755 | | yes | |
| NCU01109 | | yes | |
| NCU01292 | cuffdiff | | |
| NCU01551 | | yes | |
| NCU01649 | cuffdiff | cuffdiff | |
| NCU03011 | | yes | |
| NCU03417 | | yes | |
| NCU04285 | | yes | |
| NCU04843 | cuffdiff | cuffdiff | cuffdiff |
| NCU04851 | | cuffdiff | |
| NCU04861 | | yes | |
| NCU04862 | yes | yes | |
| NCU05006 | cuffdiff | yes | |
| NCU05189 | | yes | |
| NCU05197 | cuffdiff | cuffdiff | |
| NCU05477 | | yes | |
| NCU05762 | | yes | |
| NCU05764 | | yes | |
| NCU05766 | cuffdiff | yes | |
| NCU05859 | cuffdiff | yes | |
| NCU05933 | | cuffdiff | |
| NCU06334 | | yes | |
| NCU07180 | | yes | |
| NCU07363 | cuffdiff | yes | |
| NCU08037 | cuffdiff | yes | cuffdiff |
| NCU08155 | cuffdiff | yes | cuffdiff |
| NCU08156 | | yes | |
| NCU08170 | | yes | |
| NCU08455 | | yes | |
| NCU08554 | | cuffdiff | cuffdiff |
| NCU08622 | cuffdiff | yes | |
| NCU08700 | | yes | |
| NCU08775 | | yes | |
| NCU09272 | | yes | |
| NCU09273 | yes | yes | |
| NCU09274 | yes | yes | |
| NCU09335 | | yes | cuffdiff |
| NCU09342 | | yes | |
| NCU09714 | yes | cuffdiff | |
| NCU09782 | cuffdiff | cuffdiff | cuffdiff |
| NCU10062 | cuffdiff | cuffdiff | |
| NCU10301 | | cuffdiff | |
| NCU11565 | | cuffdiff | |
| NCU11774 | cuffdiff | cuffdiff | |
| NCU11881 | cuffdiff | yes | |

TABLE 1E-continued

Differential expression (DE) between various conditions, continued*

| Gene | Sucrose V Both Mutants DE | No Carbon v Both Mutants DE | Δclr-1 v Δclr-2 DE |
|---|---|---|---|
| NCU11974 | | yes | cuffdiff |
| NCU11989 | | yes | |
| NCU12012 | | yes | |
| NCU12014 | | yes | |
| NCU12015 | | yes | |

*Yes: Passed cuffdiff statistical test and was consistently different by a factor of 2 between all replicates of each condition. Cuffdiff: Passed cuffdiff statistical test but was not consistently different by a factor of 2 between all replicates tested.

SEQUENCE LISTING (242 sequences)

SEQ ID NO: 1 - protein, 710 aa, Neurospora crassa
MSPSSNSDSPASVVGSMTMAAQAAPNVVRQYPLPNRDFTIEIPSPQVAPTTNGVNTVKSPSTLKSSRAPNFSREGILGSAQKARNLSQSSENRPDHVNVSNGFHKAPSEESTNPLKRRNTDAGVDYPRRRATIACEVCRSRKSRCDGTKPKCKLCTELGAECIYREPGIKLDAGDKLILERLNRIESLLQLNMGLTGHTHGLGLSHNSPGMSNGTGLSGDNLMMQNPDAAGFVSVIPSGGLGTWSATATNSLSTMPKVHTNAALHLLQWPMIRDLVSRPYDPQILLQLEMAREPLHSLTKTPCVDLSNTSAYIEAYFDRVNVWYACVNPYTWRSHYRIALSNGFREGPESCIVLLVLALGQASLRGSISRIVPHEDPPGLQYFTAAWALLPGMMTSNSVLAAQCHLLAAAYLFYLVRPLEAWNLLCTTSTKLQLLLMTPNRVPVDQRELSERIYWNALLFESDLLAELDLPHSGVVAFEENVGLPCGFEGDEQEAVGRDDLWYFLAEIALRRLLNRVSQLIYSKDSLASTTSLEPIVTELDFQLTQWYESLPLPLQFPFTRTMLPDPVQTVLRLRFFACRTIIYRPYILAVLDNEQAILDPSVRDACTKCLEASIRQLEHISAHHAGHMPYLWQGALSIVSQTLLIMGATMSPSLNSILVSLVSHRDVIDQIINDVVMEIERYSVLSPSLSLSAEIIKEAEVRRRTFLSG

SEQ ID NO: 2 - DNA, 2133 bp, Neurospora crassa
atgtcgccgtcttccaacagcgactctcccgcctcggtagtgggcagcatgaccatggccgcgcaggctgctcccaacgttgtaaggcaatatcctctgccgaatcgagacttcacaatcgaaattccctcgccccaagttgcacccactaccaatggggtcaacaccgtcaagtcaccctccactctcaagtcgtcccgtgctcccaacttcagccgcgaaggtattcttggatcggcccagaaagcccgaaatctctcgcagtcgtctgaaaaccggcctgaccatgtcaatgtctctaatggctttcacaaggctcctagtgaggagagcaccaatccgctgaaaagaagaaatacggatgctggcgtcgactaccctagaagaagggcaaccattgcgtgcgaggtatgccgctcgaggaagtcgcggtgtgacggcacaaaaccaaaatgcaagctgtgcacagagttgggtgccgagtgcatatatcgcgagcctggtatcaagctggatgccggcgacaagctcatcctcgaacgcctcaacaggatagaaagtctgctgcaattaaacatgggcctaaccggtcatacccatggcctaggattatcccataactccccggggatgagcaacgggacagggttgagtggtgacaacctgatgatgcaaaatcccgacgccgccggctttgtctcggtgatccccagcggaggcttgggcacatggtccgctaccgctaccaacagcttgtcaacaatgcccaaggtccacaccaatgccgcccttcatttgttgcaatggcccatgattcgggatctcgtctcacgaccttacgacccacaaattctcctccaactcgaaatggccagggagccactccactcgctcacaaagaccccttgtgtggacctctccaacacttccgcctacatcgaagcctatttcgatcgtgtcaacgtttggtacgcctgtgtcaacccttatacatggaggagccactatcgtatcgccctctcgaacggtttcagggaaggaccagaaagttgtattgtgcttctcgtcttggctctcggtcaggcaagtttacgggggagcatatccaggatcgtgccacatgaggatcccccgggcctccaatatttcacggccgcatgggccttgctaccgggcatgatgacctccaacagcgttctcgccgctcaatgccaccttttagctgccgcttacctattctacctcgtccgacccctggaagcatggaaccttctctgcacaacaagtaccaagttgcagctcctccttatgacgccgaaccgagtgcctgtcgaccaaagggaactgagtgaaaggatctactggaatgctctgctgttcgagagcgacctcctcgccgagctggaccttccgcattctggtgttgttgcatttgaagaaaatgttggtctgccatgtggcttcgagggggatgagcaagaggcagttggtcgcgatgatttgtggtatttcctcgccgaaatagcacttcggcgactactcaaccgcgtcagccagctcatttactccaaggactccttggcctctacaacgagtctcgaacccatcgtgaccgagttggatttccaactaacgcagtggtacgagagtctacctctaccgctgcaatttccgtttactcggacaatgctcccagatcctgtccagacggtgttgcggttgcgcttctttgcttgccggaccattatttaccggccatacattctcgcggtcctcgacaatgaacaggcaatactggacccctcagtgcgtgacgcgtgcacaaagtgtctggaggcttcaatcagacaattggagcatatcagtgcacatcacgccggacacatgccgtacctttggcaaggggcactctcgattgtatcgcagacacttctgattatgggtgccactatgtcaccgtcactaaacagtattctggtgagcttggtctcacaccgcgacgttatcgaccagatcatcaacgatgtcgtcatggagatcgagcgttattccgtactctcacccagtctgagcctctcggcggagattatcaaggaagcggaggttaggcgacgaacgttcctgagtggttga

SEQ ID NO: 3 - DNA, 4181 bp, Neurospora crassa
gagcgcctctatctgcattctactaaacgaatataccaactaggtattagtcacgagacggcccactaatacacgacagtcctcatttccggtaatcgaaacacacggtggatgtctgagggactctactttgacagacagtcgcgtcttaaccagtcgccaacaacataacgattcaagcgtgttctggttcatgctgaagtggtcgtgactcgggctggttgaggtgttgtgggcaaacaaagggtcgacatttcatcactgtcttctgtccatttcggtcgactaccaagcagaccctgaccacttgcatacgacatgtcgccgtcttccaacagcgactctcccgcctcggtagtgggcagcatgaccatggccgcgcaggctgctcccaacgttgtaaggcaatatcctctgccgaatcgagacttcacaatcgaaattccctcgccccaagttgcacccactaccaatggggtcaacaccgtcaagtcaccctccactctcaagtcgtcccgtgctcccaacttcagccgcgaaggtattcttggatcggcccagaaagcccgaaatctctcgcagtcgtctgaaaaccggcctgaccatgtcaatgtctctaatggctttcacaaggctcctagtgaggagagcaccaatccgctgaaaagaagaaatacggatgctggcgtcgactaccctagaagaagggcaaccattgcggtatgtttgggctctggcgcagtggaaaaatctggtgtggtgaatctacacgctgacatttcgttgaacagtgcgaggtatgccgctcgaggaagtcgcggtgtgacggcacaaaaccaaaatgcaagctgtgcacagagttgggtgccgagtgcatatatcgcgagcctggtatcaagctggatgccggcgacaagctcatcctcgaacgcctcaacaggatagaaagtctgctgcaattaaacatgggcctaaccggtcatacccatggcctaggattatcccataactccccggggatgagcaacgggacagggttgagtggtgacaacctgatgatgcaaaatcccgacgccgccggctttgtctcggtgatccccagcggaggcttgggcacatggtccgctaccgctaccaacagcttgtcaacaatgcccaaggtccacaccaatgccgcccttcatttgttgcaatggcccatgattcgggatctcgtctcacgaccttacgacccacaaattctcctccaactcgaaatggccagggagccactccactcgctcacaaagaccccttgtgtggacctctccaacacttccgcctacatcgaagcctatttcgatcgtgtcaacgtttggtacgcctgtgtcaacccttatacatggaggagccactatcgtatcgccctctcgaacggtttcagggaaggaccagaaagttgtattgtgcttctcgtcttggctctcggtcaggcaagtttacgggggagcatatccaggatcgtgccacatgaggatcccccgggcctccaatatttcacggccgcatgggccttgctaccgggcatgatgacctccaacagcgttctcgccgctcaatgccaccttttagctgccgcttacctattctacctcgtccgacccctggaagcatggaaccttctctgcacaacaagtaccaagttgcagctcctccttatgacgccgaaccgagtgcctgtcgaccaaagggaactgagtgaaaggatctactggaatgctctgctgttcgagagcgacctcctcgccgagctggaccttccgcattctggtgttgttgcatttgaagaaaatgttggtctgccatgtggcttcgagggggatgagcaagaggcagttggtcgcgatgatttgtggtatttcctcgccgaaatagcacttcggcgactactcaaccgcgtcagccagctcatttactccaaggactccttggcctctacaacgagtctcgaacccatcgtgaccgagttggatttccaactaacgcagtggtacgagagtctacctctaccgctgcaatttccgtttactcggacaatgctcccagatcctgtccagacggtgttgcggttgcgcttctttgcttgccggaccattatttaccggccatacattctcgcggtcctcgacaatgaacaggcaatactggacccctcagtgcgtgacgcgtgcacaaagtgtctggaggcttcaatcagacaattggagcatatcagtgcacagtaagtcttcgcccgttaatattcgggttttgattggctgtcttttcctttttattacgtctcaatctaacaaaaggccgcagtcacgccggacacatgccgtacctttggcaaggggcactctcgattgtatcgcagacacttctgattatgggtgccactatgtcaccgtcactaaacagtattctggtgagcttggtctcacaccgcgacgttatcgaccagatcatcaacgatgtcgtcatggagatcgagcgttattccgtactctcacccagtctgagcctctcggcggagattatcaaggaagcggaggttaggcgacgaacgttcctgagtggttgaggaatcgctttactacactcgatgtcatagacacaaaaggtcaaacggtcccatcaaactcgccacatccaaacctttcaatcacccaaaagttaaaccgccagcagttgaacctatggtgttctgtcatggcacgaagcaagctacaggtgcatctggtcctccacggatgcaacgccagtacaagatgtatttttttcaggactgaaacagtcgctgtccaagtcgttggctgcattgactatcaaatttattcctgcgacgaaaacagccattctcttgatctgtactgccagcagacgtgaaaaataatccgggctcgctcatacacaaccaagcccagtaagtgtccggactgcattcacaccatctgcccgcctccccgccttcggaagggcgctcaccgaatggtctgaagatcataccaatgttgatcgaccagccttgcctgataacctgataaaccatggccctgactatgggcacgccggtttttgtgagcatttgacctacttctatctcatacactcctgttgtagctggctacaacgtggtatcttgactggaaaccccgaccagcgaccgacagacaatcccattctcttgttcttcacgactttgcacaggctgagcaccctttgcctctccccagaaacgtggatgaccagcaacggagcgccaagcagaacaccttgcaacaaggtctgtcgaagccggagcatacggcctggggtagcacaccttgggtgcagaagaatttgaacagtgcccgatctgcctgtggttgatgatgggctgtgtgttggatggcacattgatgcggatacgacgggccgaaaatccggaaacaccccacttctttgacccttgctcagcttttaatgatgttcttccaatgttccattacttttctgcccctctctgcccctgattcagacagcaactgtttgtgggagcgtttacattatagtgaatgttggccttgagtcgatttccctgatgggcgggccggaagaagcgagaagggggcgactttcgcatatcatcattacttgcaaatcttctctacctaccatccaccaaagttgtacacttgcagacgggcttctacacatacatgaaggaaacttgagagtgaacattattttcagcccttacgttctcgacgttcggtggacgaccaaccccctgtgaacaatttatggcatttatccgacctcctggctttggtatattcgggttgacgctttggtggttctgaagcttattcaaggttttcaaagtcatgtaacaaagatgagatgaaatgcccaaagtttgttttcgtcatgtcgtttctctggaagcacttcttgcttatggctggcttttggtgttggagggcatcggcaaacgggaccaaaacatatgcaatctcaatgaggacgttgaagctgtgccatactatgattctctgttatttctctttccttgttgggatggttggttgtctctcgccttttcttctctttttatttacaaacaggatacctcctacacttcacaatacccaatactttactattctttttgcaaa

SEQ ID NO: 4 - protein, 812 aa, Neurospora crassa
MAPSMSIPTQGGMFHTFQGVTPRKPAVDSRDSVKSNGSGAAKRITTPHACAECKRRKIRCDGQQPCGQCLSSRAPKRCFYDKHRQRVIPSRKTLEALSQSLEECRSILKRLYPHQEVHALLPLSRQELLNLLDRPVPDSTTANGLPSPPLNTTPMAESETPTKSENILEQIPTRDTEWDEERRERDHIPVEADDINALSLSVDRQASYLGASSIKAALMVMLKVQPGLRSSLAAPLNSIEISHNFPAIRQKSSSQKDPQRIPWSWKGQTLIDAYFKRVHVFIPMLDETTFRADYLEGQRFDAPWLALLNMVFAMGSIVAMKSDDYNHVNYYNRAMEHLPMDSFGSSHIETVQALALIGGYYLHYINRPNMANAVLGAAIRMASALGLHRESLAQGGSDMVAAETRRRTWWALFCLDTWATTTMGRPSFGRWGPAINIRPPEFGVNAGRDSSQHAGILPMIENVKFCKIATQIQDMLAISPLLRTEDRCNLDGQLVVWYENLPWLLRTTDPCAEPLYMARCIMKWRYQNLRMLLHRPVLLSMASSGLNPHTQACDADLAAIETCRELAAATIEDIGREWTRNQMSGWNAVWFLYQAAMVPLVSVFWQWGNPRVPEWLKQIEAVLELLEAMEEWSLAARRSREVVLRMYEASRVIQAQGAAAHQLQQRGSQSPHSLSSTTASLGNMHINNDLLMGSSPGSAELYMTPIDLEPVEGLGMTGVLDHGGMWDLDGMLWGPSPSPSVHHGQHSTHPDDAVPTVAEYAAAFPTADVVDGFLQHHSAMEFGNMMGHHHHHHHAGAHAGQGQFGGMDGYTY

SEQ ID NO: 5 - DNA, 2439 bp, Neurospora crassa
atggcaccatcaatgtcgatacctacacaaggcggcatgtttcacacattccaaggagtcacaccacgaaagccggctgttgactctcgagatagtgttaagtccaatggtagtggggcagccaagaggataactactcctcatgcttgtgctgagtgtaaaagacgaaagattcggtgtgatggtcaacaaccatgtggccaatgtctctcaagccgagcaccgaaacgttgtttctatgacaagcaccgccaaagggtgatcccatcgcgcaagacactcgaagccctctcccagtccctcgaagaatgccgatcgattttgaagcgactgtatcctcaccaagaagtccacgccttgcttcccttgtccaggcaagaactcctcaacctcctggatcgacccgtcccggacagcacaacagcgaacggactaccgtcacctcctctaaacacaacaccgatggccgagtcagagacaccaaccaagtctgaaaacattttggaacagattccgactcgggatacagaatgggacgaggaacgccgggagagggaccatatccctgtagaggcggacgatatcaacgcgctgtcactctcggtggacagacaagcttcttatcttggagcctcatccatcaaggctgcccttatggtcatgctcaaggttcaaccaggcttgaggagctccttggccgccccgctcaacagtatcgagatttctcataacttcccggccatcagacagaaatcatcgagtcagaaagatccccagcggatcccatggtcatggaagggacagacacttatcgatgcctacttcaagcgagtccacgtcttcatcccaatgctcgacgaaacaaccttccgtgccgattaccttgaaggtcaacgatttgacgcaccgtggttagccttgttgaacatggtattcgccatgggtagcattgtggcaatgaagtcggacgattacaatcacgtcaactattacaaccgcgccatggagcatcttcccatggattcctttggcagcagccatatcgagactgtccaagcattggcactcatcggtggttactatcttcactatattaaccgacccaacatggccaacgctgttttgggtgccgccatccgcatggccagcgctctcggtctccaccgtgagagtcttgcccaaggaggaagtgatatggtcgctgccgagaccaggagacgcacatggtgggctcttttctgccttgacacgtgggccacgacaaccatgggacgtccctcttttggccgttggggacccgccatcaacattcggccgcccgagttcggtgtgaatgccggtcgggactcgtctcaacacgcgggtattctccccatgattgaaaacgtcaagttctgcaaaatcgccactcagatccaagacatgctcgccatttctcctttgctgcgtaccgaggaccgctgcaatctggacggacagctcgttgtctggtatgaaaacctaccttggctcctgcgtacgaccgacccatgcgctgagccgctctacatggcccgctgcatcatgaagtggcggtatcagaacctccgtatgcttcttcatcgcccagtcctcctctccatggcctcatcaggtcttaacccacatactcaggcctgtgacgcggatctcgccgccattgagacgtgccgagagcttgctgcggcaaccattgaggacattggtcgtgaatggacacgtaaccagatgtccggctggaacgcagtgtggtttctctaccaggctgccatggttcctcttgtctccgtcttttggcaatggggcaaccctcgtgtccctgagtggctcaagcagattgaggcggtattggagctccttgaggccatggaagagtggtcactcgctgctcgcaggagccgggaggtggttcttcgcatgtacgaggccagcagagtcatccaggcacagggtgccgcagcgcaccaactacagcagaggggatcgcagagccctcattctctcagcagcactactgcgtccttgggcaacatgcacatcaacaacgacttgctcatggggtcgtcaccgggttcggcggagctctacatgactcctatcgacctggagcccgtcgaaggcttgggcatgacgggtgtgctggaccacggcgggatgtgggatctcgacggcatgctttggggtcccagtccaagcccgtcggttcaccatggtcaacactcgactcacccggatgatgcggtgcccacggtggcggagtacgctgcagcgttcccgacggctgatgtagtagatgggtttctgcaacatcactcggctatggagtttgggaacatgatgggtcaccaccaccaccaccaccatgcaggtgcacatgctggccagggtcagtttggaggtatggatgggtacacctactga

SEQ ID NO: 6 - DNA, 3442 bp, Neurospora crassa
ttatcacaacctggggctgaggctgaggtgaagtgcaatggaccaattcccaactcggttcaatgtaaatatataagtttgcatacgctcctcacggtctcggccaccccctcattgtcccccagggtctgtctttagtttgtttattattggcgaggacaaaatatcaatcttaagcccacacaaggttttcagttcctggtgatcaaggtctcgccactttcacgaactcgccggttgatattcgggccttgcttggcaacccatcatacatttataccttttctgtggctgcgagtggcttcccagctttccgcaagttgtattcccattcagacagcctctgatcagcaaagcgtccataatggcaccatcaatgtcgatacctacacaaggcggcatgtttcacacatgtaagtttgatgaccttttccaaccaaggggtccattactaatgagcaaatccagtccaaggagtcacaccacgaaagccggctgttgactctcgagatagtgttaagtccaatggtagtggggcagccaagaggataactactcctcatgcttgtgctgagtgtaaaagacgaaagatgtaagtcaatgcgtgtcgatcagcctcaccatcaatctaacttgagtgccctagtcggtgtgatggtcaacaaccatgtggccaatgtctctcaagccgagcaccgaaacgttgtttctatgacaagcaccgccaaagggtgatcccatcgcgcaagacactcgaagccctctcccagtccctcgaagaatgccgatcgattttgaagcgactgtatcctcaccaagaagtccacgccttgcttcccttgtccaggcaagaactcctcaacctcctggatcgacccgtcccggacagcacaacagcgaacggactaccgtcacctcctctaaacacaacaccgatggccgagtcagagacaccaaccaagtctgaaaacattttggaacagattccgactcgggatacagaatgggacgaggaacgccgggagagggaccatatccctgtagaggcggacgatatcaacgcgctgtcactctcggtggacagacaagcttcttatcttggagcctcatccatcaaggctgcccttatggtcatgctcaaggttcaaccaggcttgaggagctccttggccgccccgctcaacagtatcgagatttctcataacttcccggccatcagacagaaatcatcgagtcagaaagatccccagcggatcccatggtcatggaagggacagacacttatcgatgcctacttcaagcgagtccacgtcttcatcccaatgctcgacgaaacaaccttccgtgccgattaccttgaaggtcaacgatttgacgcaccgtggttagccttgttgaacatggtattcgccatgggtagcattgtggcaatgaagtcggacgattacaatcacgtcaactattacaaccgcgccatggagcatcttcccatggattcctttggcagcagccatatcgagactgtccaagcattggcactcatcggtggttactatcttcactatattaaccgacccaacatggccaacgctgttttgggtgccgccatccgcatggccagcgctctcggtctccaccgtgagagtcttgcccaaggaggaagtgatatggtcgctgccgagaccaggagacgcacatggtgggctcttttctgccttgacacgtgggccacgacaaccatgggacgtccctcttttggccgttggggacccgccatcaacattcggccgcccgagttcggtgtgaatgccggtcgggactcgtctcaacacgcgggtattctccccatgattgaaaacgtcaagttctgcaaaatcgccactcagatccaagacatgctcgccatttctcctttgctgcgtaccgaggaccgctgcaatctggacggacagctcgttgtctggtatgaaaacctaccttggctcctgcgtacgaccgacccatgcgctgagccgctctacatggcccgctgcatcatgaagtggcggtatcagaacctccgtatgcttcttcatcgcccagtcctcctctccatggcctcatcaggtcttaacccacatactcaggcctgtgacgcggatctcgccgccattgagacgtgccgagagcttgctgcggcaaccattgaggacattggtcgtgaatggacacgtaaccagatgtccggctggaacgcagtgtggtttctctaccaggctgccatggttcctcttgtctccgtcttttggcaatggggcaaccctcgtgtccctgagtggctcaagcagattgaggcggtattggagctccttgaggccatggaagagtggtcactcgctgctcgcaggagccgggaggtggttcttcgcatgtacgaggccagcagagtcatccaggcacagggtgccgcagcgcaccaactacagcagaggggatcgcagagccctcattctctcagcagcactactgcgtccttgggcaacatgcacatcaacaacgacttgctcatggggtcgtcaccgggttcggcggagctctacatgactcctatcgacctggagcccgtcgaaggcttgggcatgacgggtgtgctggaccacggcgggatgtgggatctcgacggcatgctttggggtcccagtccaagcccgtcggttcaccatggtcaacactcgactcacccggatgatgcggtgcccacggtggcggagtacgctgcagcgttcccgacggctgatgtagtagatgggtttctgcaacatcactcggctatggagtttgggaacatgatgggtcaccaccaccaccaccaccatgcaggtgcacatgctggccagggtcagtttggaggtatggatgggtacacctactgaaggcccctcgcagtgctccaattttctagtttactactcatttctctctttctttctttctttcttcctcttttcacacaaaaaatagttgggctggaagcccggggttatgcacagttggcgcgacgcaggcttgaaggaccgaaataccaccacatacgatggctggatgcgggtggtgcggatttggcttacgaatggttgctttttgcggggtacatcatatacggagaaggataagggtctcatggtaaaaaggaaaagggagctttgttttttggcggttgatttctcagggaatgttggtttgatttttggctgattttggatggttacaacggcgccttcgcgggtacactctccctcttgttaggtgtagtgtcccacctcccttccattcaccagccaccggccttacctaggccgttgtcatgtgggcctagttcagggcaccaccatgttcattgtattattattatagccctttttacatttcatttccactttagcttcttaacacagtcatcaac

SEQ ID NO: 7 - DNA, 18 bp, Artificial Sequence
  Synthetic Construct
atgacgccgaaccgagtg

SEQ ID NO: 8 - DNA, 19 bp, Artificial Sequence
  Synthetic Construct
caacaacaccagaatgcgg

SEQ ID NO: 9 - DNA, 18 bp, Artificial Sequence
  Synthetic Construct
tcccggccatcagacaga

SEQ ID NO: 10 - DNA, 19 bp, Artificial Sequence
  Synthetic Construct
atcggcacggaaggttgtt

SEQ ID NO: 11 - DNA, 18 bp, Artificial Sequence
  Synthetic Construct
tgatcttaccgactacct

SEQ ID NO: 12 - DNA, 18 bp, Artificial Sequence
  Synthetic Construct
cagagcttctccttgatg

SEQ ID NO: 13 - DNA, 19 bp, Artificial Sequence
  Synthetic Construct
atctgggaagcgaacaaag

SEQ ID NO: 14 - DNA, 18 bp, Artificial Sequence
  Synthetic Construct
tagcggtcgtcggaatag

SEQ ID NO: 15 - protein, 614 aa, Aspergillus clavatus NRRL 1
MTPSPERDLVLDSASTAAIGEFQVSKKKRSSSELAEYPRRRATIACQICRLRKTREPGIKLDAGDKLIIERLNRIEGLLQSNLLGQASHFPLSSTSPATSNDTNVGSDDAAAKASTIAAMSGRTSIAGLASWANPPTSISTMPKVHTTPALHLLQWPLIRDLIAGPYDAQALLQLEMAREPLRIPTSVGFDLTNSATYVQAFFEKVNVWYACVNPYTWTTYHNKAVSRSFQEGPESCVVLLVLALGSASHYGSIAFIPPDMEPPGLPYFAAAWNLLPSVMMRNSVIAAQCVVLASAYLFYLVRPLEAWTLLSNASMKLQLLFGDPARVPLQWRELSVRVYWNALLYESDLLAELDLPHSGIIHFEELVDLPGGFEEEVEEDEDDIENSDRESAPVNGSAGREELWYFLAEIALRRLLNRVSHLLYQKDSSLTLGSLGPIVSELDFQLSQWYDNLPQPVQFPLNHAPISNPVQTVLRLRYYACRTIIYRPYIQAVFENEQAAADQVVRERCRRCLEATLRQLENITSHREGHLPYLWQGALSMVSQTLLIMGATMSPGLSTLLPPGFRVDAIISSVITEVGRYAHLAPSLKLSAEIIRDAEKRRKICLRSTTGRV

SEQ ID NO: 16 - protein, 495 aa, Aspergillus flavus NRRL3357
MSGKTSVVGLASWANPPTSISTMPKVHTTPALHLLQWPLIRGLVAGPYDPHTLLQLEMAREPLRMKAPKELDLTNATIYIRNFFRRVNVWYACVNPYTWSRYYKTAVSLSFREGSESCLVLLVLALGCASHYGSISSVSPDKEAPGLPYFAAAWDLLPIVMMRNSVPAAQCIILASAYLFYLVRPLEAWTLLSNASLKLQLLFGNPSRVPLQWKELSVRIYWNALLYESDLLAELDLPHSGIVHFEELVDLPGGFEEEDDEEYQEAEDAHGEIASETEPVGHDELWYFLAEIALRRLLNRVSHMVYQKDSPLTLGTLGPIVSELDYQLSQWYESLPQPVQFPLSRTPVSNSVQTALRLRYFACRTIIYRPYMLAVFENEQTSLDPVVKECCRRCIEATIHQLENITSHREGHLPYLWQGALSMVSQTLLIMGATMSPTLSALLPPADQVDRMISEVVAEVERYAHLAPSLKLSAEIIRDAEKRRQICLRSTGRCT

SEQ ID NO: 17 - protein, 651 aa, Aspergillus niger
MSCQELDSDTILDSTSAKKRNNSEATEYPRRRATIAYHPVPSHFLSPGTSSATKTSNTNVRALLQCQICRLRKTRCNGARPRCQLCVDLDADCVYREPGIKLDAGDKLIIEKLNRIEVLLQSKFADPIGQSPLSSNSSTAANLVQISSDDAVSLANIPTRTIAVGLGSWANPPTSISTMPRVHTTPALHLLQWPLIRELVAVPYDPHTLLQLEMAREPLRLEPPVSLDLSNALTHARLFFERVNVWYACVNPLTWPRYYKMALSRDFERGPESCVVLLVLALGSASQYGSISCLSADEELPGLSYFSAAWTLLPAVMTRNSVLAAQCVILASAYLFYMVRPLEAWTLLSNASMKLQLLLGNPSRVPGQWKELSTRVYWNTLLFESDLLAELDLPHSGIVHFEELVDLPGGFEPEDEEDEEDEGSIRIEEKLVDAMIGQDELWYFLAEIALRRLLNRVSHMIYQKDSILTLASLGPIASELDFQLSQWYESLPQPVRFPLSGGPTLSPIQTVLRLRYFACRTIIYRPYILAVFQNEYACSDPTVKDCCLRCLDATLNQLEHIDRHREGHLPYLWQGALSMVSQALLIMGATMSPTLSSLLPPATQLDGIISGVITEVGRYARLAPSLKLSAEIIRDAEKRRQVSLASAARRG

SEQ ID NO: 18 - protein, 638 aa, Aspergillus oryzae RIB40
MSPSPQRDRDTHVEAVAAVTASDDFQSSKKKRSNSDVVEYPRRRATIACQICRLRKTKCNGARPKCQLCTDLDTECVYREPGIKLDAGDKLIIERLNRIEGLLQSSLASQAAHCSLPSTSPATSNDTNIGGEDTPVKTSSVAVMSGKTSVVGLASWANPPTSISTMPKVHTTPALHLLQWPLIRGLVAGPYDPHTLLQLEMAREPLRMKAPKELDLTNATIYIRNFFRRVNVWYACVNPYTWSRYYKTAVSLSFREGSESCLVLLVLALGCASHYGSISSVSPDKEAPGLPYFAAAWDLLPIVMMRNSVPAAQCIILASAYLFYLVRPLEAWTLLSNASLKLQLLFGNPSRVPLQWKELSVRIYWNALLYESDLLAELDLPHSGIVHFEELVDLPGGFEEEDDEEYQEAEDAHGEIASETEPVGHDELWYFLAEIALRRLLNRVSHMVYQKDSPLTLGTLGPIVSELDYQLSQWYESLPQPVQFPLSRTPVSNSVQTALRLRYFACRTIIYRPYMLAVFENEQTSLDPVVKECCRRCIEATIHQLENITSHREGHLPYLWQGALSMVSQTLLIMGATMSPTLSALLPPADQVDRMISEVVAEVERYAHLAPSLKLSAEIIRDAEKRRQICLRSTGRCT

SEQ ID NO: 19 - protein, 637 aa, Aspergillus terreus NIH2624
MSPSPDRDRDTVLDPAIVAASIDFPDGKKKRSNSEATEYPRRRATIACQICRLRKTRCNGARPRCQLCTDLDADCVYREPGIKLDAGDKLIIERLNRIEGLLQSSLVGQHPPFPQSSTSPATSNDTNLGSDDMVNKSSLTSLSGRTSVAGMASWANPPASISTMPKVHTTPALHLLQWPLIRDLVAGPYDPHTLLQLEMAREPLRMTTVAGLDLSNANTYVQSFFERVNVWYACVNPYTWSQYHKRAMAQGFQEGAESCVVLLVLALGCASHYGTISSIPPDREAPGLPYFTAAWNLLPSVMMRNSVLAAQCIILSSAYLFYLVRPLEAWTLLSNASMKLQLLFGNTSRVPAQWKELSVRVYWNALLYESDLLAELDLPHSGIVHFEESVDLPGGFEEDDEEEEDEDPVENPHNGMIHSDSVGNDELWYFLAEIALRRLLNRVSHMIYQKDNTLTLASLGPIVSELDFQLSQWYDSLPRPVQFPLAHTPFSNPVQTVLRLRYYACRTIIYRPYILAVFENEQTSADPLVKECCRRCLEATLRQLEDITSHREGHLPYLWQGALSMVSQTLLIMGATMSPALAALLPPPIRVDGIIAGVMAEVDRYAHLAPSLRLSAEIIRDAERRRQVWIRSSGKRL

SEQ ID NO: 20 - protein, 507 aa, Metarhizium acridum CQMa 102
MSASRDKAYNPMARSRLLSQFSDKAPATPLQLANSDGLLSSLRGNEVILLLIILGAEQLLLLFVIDAYMGFLWRQCEVCRSRKSRCDGSKPKCKLCAELGAECVYREPGVKLDAGDKLILEQLNRTENLLQINLVTNQASGLHLSQSSPSVSNGTASGGDQALLSNSSNTASTIPNGGLGTWGRNGFVERLSGRPRELYRATSASTWQRKPPRNMITTKNVLAAQCHLLAAAYLFYLVRPLEAWNLLCTTSTKPQLPLMAPHRISQRQRELVERTYWNTLLLESDVLAELDLPHFGIVQFEKNVGLPGGFEGEEQGQEQIGHDDLWYFLAEIALRRLLNRANQLIYSKDSVASTTSPEPVVAELDYQLTQWYEGLPPSLQFPFSRTMLHDPIQAVLRLRFYACKTIIYRPYILAVLENEQAVLDPAVRGCCHKCLEASVRQLEHIMEHHAGQMSYIWQALDDLISEVITGVQNYASLAPSLRLAVSMARVREPRFVLSQRRAISPGQ

SEQ ID NO: 21 - protein, 602 aa, Mycosphaerella graminicola IPO323
MDQDLAFDEIPDYPRRRAMIACEICRSRKSKCDGSRPKCKLCIDLNAACVYREPGVKLDAGDKIILDRLANIEALIQSKFPTLSQADSSTAGPLALPAEQGRTVGNGPGSIPLSGFGISQAAMNISTMPKAHTTPALHLLQWPCICDLVTSPCDPQVLLQLEMTRPPLDLRSHYPLDLSDLCSSIYTRAFFGKVNVWYAVVNPHSWNELYRTASLNSFRSGPESCVVLLVFALGQAAHTDTSTAHASYDGRPPGTAYFEAAWQLLPTLMLRNNVMSAQCHILAAAYLLYLVRPLEAWNLLCSVSIKLQLLLSSSSPLPSAEARNLLERIYWNTLMFESDLLAELDLPHSGIVQFEESMPLPRSFPLTPISPSPSSSAPAPSPGSDEIWYFLAEIALRRLLNRVSHLLYSKSLSLASLAPLVTELDLQLTQWHNHLPPSVQFPIRPSSSLPDEALDPVQTVLRLRYHACRTIIHRPYILYVLSSATPTVGNSTSHISEACATGLESAYIQISLLSSHRAGHVPYLYQGFLSLVSQTLLLLGASLHTELRRLMPVRKEALVKTVDSVRIELNTLGRLAPSLEVSGGILGDAVDRWKERISGVEW

SEQ ID NO: 22 - protein, 495 aa, Neosartorya fischeri NRRL 181
MSGRTSVAGLGSWVNPPTSISTMPKVHTTPALHLLQWPLIRDLVARPYDPQTLLQLEMAREPLRFPSAAGFDLSNTTTYVQSFFERVNVWYACVNPYTWTRYYSKAVSLGFREGPESCLVLLVLALGSASHYGSISFIPSDMDPPGLPYFATAWNLLPSVMMRNSVLAAQCIILASAYLFYLVRPLEAWTLLSNASMKLQLLFGDPARVPLQWRELSVRVYWNALLYESDLLAELDLPHSGIVHFEEVVDLPGGFEEEEDEEDDEADNEDRQTSLVEGSVGREELWYFLAEIALRRLLNRVSHMIYQKDNSLTLGSLGPIVSELDFQLSQWYESLPQPVQFPLSHTPISNPVQTVLRLRYYACRTIIYRPYILAVFENEHAATDQVVRECCRRCLEATLRQLENITSHREGHLPYLWQGALSMVSQTLLIMGATMSPGLSTLLPPGFRVDAIISSVMAEVERYAHLAPSLKLSAEIIRDAEKRRQICLRSTSRRV

SEQ ID NO: 23 - protein, 633 aa, Aspergillus fumigatus Af293
MTPSPERDLVLDSATAGGTTESQVSKKKRSNSELTEYPRRRATIAICRLRKTRCNGARPRCQLCTDLDADCVYREPGIKLDAGDKLIIERLNRIEGLLQSTLVGQATHLPLSSTSPTTSNDTNAGSDDAVAKASTIAAMSGRTSVAGLGSWVNPPTSISTMPKVHTTPALHLLQWPLIRDLVAGPYDPQTLLQLEMAREPLRLPSAAGFDLSNTTTYVQSFFERVNVWYACVNPYTWTRYYSRAVSLGFREGPESCLVLLVLALGSASHYGSISFIPSDMDPPGLPYFAAAWNLLPSVMMRNSVLAAQCIILASAYLFYLVRPLEAWTLLSNASMKLQLLFGDPARVPLQWRELSVRVYWNALLYESDLLAELDLPHSGIVHFEEVVDLPGGFEEEEDEEDDEADNEDRQSSLVEGSVGREELWYFLAEIALRRLLNRVSHMIYQKDNSLTLGSLGPIVSELDFQLSQWYESLPQPVQFPLNHTPISNPVQTVLRLRYYACRTIIYRPYILAVFENENAATDQVVRECCRRCLEATLRQLENITSHREGHLPYLWQGALSMVSQTLLIMGATMSPGLSSLLPPGFRVDAIISSVMAEVERYAHLAPSLKLSAEIIRDAEKRRQICLRSTSRRV

SEQ ID NO: 24 - protein, 632 aa, Aspergillus nidulans FGSC A4
MSSSPERDREGILDSTSASLNELINKKRSNSEATEYPRRRATIACQICRLRKTRCNGARPKCQLCTDLDAECVYREPGIKLDAGDKLIIERLARIEGLLQTSLAAQNSQLTLSSTSPATSNGTNVGSDDTVAKASTHLAVTGRTTSIVGLASWANPPTSISTMPRVHTTPALNLLKWPLIRDLVARPYDSQTLLQLEMAREPLKMTPPMAVDLSCAPLYIRTFFEKVNVWYACVNPYTWSKYYDAAVSLSFREGPESCVVLLVLALGCAAQCGSIALISTDRDPPGVPYFIAAWNLLPSVMMRNSVVAAQCIILAAAYLFYLVRPLEAWTLLSNASMKLQLLFGNPSRVPVQWRELSVRVYWNALLYESDLLAELDLPHSGIVNFEELVDLPGGFDEIEDDEDEDDGDTGNKLVSPIGCDELWYFLAEIALRRLLNRVSHMLYQKDNSLTLASLAPIVSELDFQLSQWYEGLPQPVRFPLSHAPISHPVQTVLRLRYFACRTIIYRPYILAVFENEQASGDSWVRECCRRCLEATLYQLESVTTHREGHLPYLWQGALSMVSQSLLIMGATMSPALSSLLPPTLRVDEIISSVIVEVDRYAHLAPSLKLSSEILRDAERRRQICLRSSGSRV

SEQ ID NO: 25 - protein, 651 aa, Aspergillus niger; identical to SEQ ID NO: 17

SEQ ID NO: 26 - protein, 638 aa, Aspergillus oryzae RIB40; identical to SEQ ID NO: 18

SEQ ID NO: 27 - protein, 535 aa, Botryotinia fuckeliana B05.10
MSISSQGNSPNSTSGSIRHFSMSRDKFDIDISSPQLSIVTNSDLTSPTSLKSPNGRRIATFSREGILGSAQKARNLSQSSADRESITNALQSRQNHNHNHNQNQNRNGNGNTNGNGNQNGNSDDGINPLKRRSTDAGIDYPRRRATIACEICRSRKSRCDATKPKCKLGTELGAECIYREPGIKLDAGDKLILEHLTRIEGLLQSTLIGQTSNLALSTGSPSINGGTTASGEDLLMAASGGFASMIPATGLGTWAIPTNISTMPKIHTNAALHLLQWPLIRDLVSRPYDPQILLQLEMAREPLALSKAPCLDLSNTSAYIEAFFAKVNVCTSTKLQLLLSAPGRIPASQRELCERVYWNSLLFESDLLAELDLPHSGIVQYEEIVGLPGGFEQEDEDGVGRDELWYFLAEIALRRLLNRVSQLIYSKDSMASTSSLEPVVAELDFQLSQCHAGHMPYLWQGALSIVSQTLLVMGATMSPSLSAIINSLVIHDTIDGIINDVVMEIERYAHLAPSLSLSAEIIREAEMRRRSYLGG

SEQ ID NO: 28 - protein, 704 aa, Chaetomium globosum CBS 148.51
MSPSSNGDSPHSVTATMTTAASATVVRQQYPLPNRDFTVDIPSPQLAAGSNGAGLLKSPNSLKAARAASNFSREGILGSAQKARNLSQSSDNRPDGVPNGIPKSTSEESINPLKRRNTDAAVDYPRRRATIACEVCRSRKSRCDGTKPKCKLCTELGAECIYREPGIKLDAGDKLILERLNRIENLLQMNMVGHGNGISLSHDSPNMSNGTALSGDNLMMRNANNEFVSIIPSGGLGTWSATATNISTMPKVHTNAALHLLQWPLIRDLVSRPYDPQILLQLEMAREPLHSLAKTPCVDLSNTNAYIEAYFDRVNIWYACVNPYTWRSHYRIALSNGFREGPESCIVLLVLSLGQASLRGSISRIVPHEDPPGLQYFTAAWSLLPGMMTSNSVLAAQCHLLAAAYLFYLVRPLEAWNLLCTTSTKLQLLLMTPNRVPADQRELIERIYWNSLLFESDLLAELDLPHSGVVAFEENVGLPCGFEGDEQEAVGRDELWYFLAEIALRRLLNRVSQLIYSKDSMASTTSLEPVVAELDFQLTQWYESLPVPLQFPFTRTMLADPVQTVLRLRFFACRTIIYRPYILAVLDNEQAILDPAVRDSCTKCLEASVRQLEHIAAHHAGHMPYLWQGALSIVSQTLLVMGATMSPSLSSILWSLVPHREAIDQIINDVVMEIERFAVLSPSLSLSAEIIKEAEVRRRTFLSG

SEQ ID NO: 29 - protein, 696 aa, Gibberella zeae PH1
MSPSSTGESAHSISINSARPFTVPARDSFALDLPMSSLATMSADASLKSPVSYKNQRTPSFSMVTSQKARHLSQSSDNNRPDNMSNGGQKVSSDEGSNPLKRRNTETGVDYPRRRATIACEVCRSRKSRCDGTKPKCKLCTELGAECIYREPGIKLDAGDKLILERLNRIESLLQMSMVNTTANGLGLTENSPGMSNGTGLDGDNLILSANAATFSSIPNGGFGTWSAQPVGTNISTMPKVHTNAAMHLLQWPLIRDLISRQCDPQVLLQLEMAREPLHTLTKTPCVDLSNTQAYIEAYFERVNIWYACVNPYTWRSQYRTALSNGFREGPESCIVLLVLALGQASLHGSISRILPHEDPPGLQYFTAAWSLLPGLMTANSVVAAQCHLLAAAYHFYLVRPMEAWNLLCTTSTKLQLLLMAPSRIPSHQRELVERIYWNALLFESDLLAELDLPHSGVVQFEEHVGLPGGFEGDESEQVGRDELWYFLAEIALRRLLNRVSHLIYSKDSIANTQSLDPVVAELDYQLSQWYESLPLPLQFPFTRNALQDPVQTVLRLRFFACRTIIYRPYILAVLDNEQQVLDPAVRENCHKCLEASLRQLEHIHEHHAGHMPYIWQGALSMVSQTLLIMGATMSPSLLNILLTLVPSREALDQIINDVVMEVERYATLAPSLSLASEMLKEAEYCFSIISPRVLD

SEQ ID NO: 30 - protein, 692 aa, Glomerella graminicola M1.001
MSPSSTGDSPCSATGNAGRPFHVPSRETFNIEVPSPSMTNGIHPLKSPTSLKTQRTPSFSRDGILGSAQKARNMSHSSENRPEALANGMDKAPSDEGSNPLKRRNTDAGIDYPRRRATIACEVCRSRKSRCDGTKPKCKLCTELGAECVYREPGIKLDAGDKLILERLNRIESLLQMNMVAGQGNGIAINQESPSMSNGSGLNGESIMGVSGSGNIVSVIPNGGLGTWNNPTNISTMPKMHTNAALHLLQWPLIRDLVSRPYDPQVLLQLEMAREPLHSLTKTPCVDLSNTTAYIEAYFERVNVWYACVNPYTWRSHYRTALSNGFREGAESCIVLLVLALGQASLRGSISRIVPGEDAPGLQYFTAAWALLPGMMTSNNVLAAQCHLLASAYLFYLVRPLEAWNLLCTTSTKLQLLLMSPNRVPPNQRELTERIYWNSLLFESDLLAELDLPHSGVVQFEENVGLPGGFEGEEQEAIGRDDLWYFLAEIALRRLLNRVSQLIYSKDSMASTTSLEPVVAELDFQLTQWYESLPMPLQFPFTRNLLSDPVQTVLRLRFFACRTIIYRPYILAVLDNEQAVLDPAVRDSCHKCLEASIRQLEHISQHHAGHMPYLWQGALSIVSQTLLVMGATMSPSLSSILLTLVPHRETIDQIINDVVMEIERYSTLAPSLSLAAEIIKEAEVRRRAYLSG

SEQ ID NO: 31 - protein, 696 aa, Grosmannia clavigera kw1407
MPTSNSPTVATAVTAATARHSSAMDASDGGLSVDAGSPQRSVGLGRDGILSAPSSDGSDVNSPSLAGTIGAAPPSASSQAGLVTDANPLKRRNADASADYPRRRAMIACEVCRSRKSRCDGTKPKCKLCTELGATCIYREPGIKLDAGDKMILERLGHIENLLQMNLADAISSSSTQQQQQSPRRESSALSTLWPSIAAETSPFVSVVPASTIGTWSSTTNISTMPKVHTNAAMHLLQWPLICDLVTQPYDPQILLRLEMARESLPSLAQTPRIDLSNMAAYITAYFERVNVWYACVNPYTWHNLYGTALANGLREGPESCIVLLVLALGQAGLGGSISRLVPRCDPPGLSYFTAAWALLPAMMTSNSVLAAQCHLLAAVYLFYLVRPLEAWNLLCTTSTKLQLLLMVPDRVPSGQRELTERIYWNALLFESDLLAELDLPHSGIVQLEENVGLPCGFEGRDPTDSQQATTLDSTAAGRDDLWYFLAEIALRRLLNRVSQLLYARDAAASPASLGPIVAELDYQLTQWYDNLPAPLQFSFASVPLADRVQTVLRQRFFACRTIIYRPYILAVLDREQGREQAVMLEPAVRAACHHCLESAVRQLENVTANQDGHMPYLWQAALSFTSQALLVMGASMSPSLADILLSIVPSRAMLDQLMANVVAETARYAILAPSLSLAADIVRQAEARRREYLGG

SEQ ID NO: 32 - protein, 710 aa, Leptosphaeria maculans
MAGITPSPDVSPVSAATTNGQFPRDSFCLNLSTLPDASSFLLKSALRSPHLLESPNGLFSGCGGLSNPFRKRPRNMSQSSGTDREMSSDTPPAQTNGIAPTSNGANGTDSRPSSKKRPSTDTIDYPRRRATIACEICRSRKSRCDGTRPKCRLCTELNAECIYREPGIKLDAGDKLILEHLNRIEGLLQTGLTSGFSLSSHSPTASNSTSEDFLGRSTGTMSHLGMVQPINGIGTWTNHPLNISTMPKTHNTAALNLLSSPMIRELVSRQYDAKILLQLEMSRDSVSLGTSRGLDLSNTGAYVQAYFERVNVFYACVNPYTWSSHYQTALSHGFRDGPESCIVLLVLALGHAGSTGSITQQDPTKDPPGMAYFAAAWNLLPTVMTRNNMVAAQCQILAAAYLVYLVRPVEAWNVLSGASMKLQLLLSAPGRISPAEEELGKRVYWNAVMIESDLLAELDLPHSGIAQFEEGFSLPTGFEDLGTEAVGRDELWYFLAEIALRRLLNRVSSMLYIRTTPYSKGPAATSIAQLDPLVIELDFQLNQWYAGLPRAMQFPLDRVPLQNPVQTVLRLRYFACRTIIFRPYVLLVLQDESLAMDSSVQDNCHKCLEACVRQLEYITAHHAGHLPYLFQGALSIISQTLLIMGATMTPSLSQLLPPPATMDDIINNVVLEMERYAHLAPSLRLSAEIIREAEGKRQLWLRTAGLKFEV

SEQ ID NO: 33 - protein, 642 aa, Magnaporthe oryzae 7015
MSPSSTGESPPTILNGHSAPALNTSNPPSALKSPATVKSQRTPSFSRDSILGSALKAGASQRADFSGDGRLGDPNGLQKVSSDEGSNPLKRRNTDAGVDYPRRRATIACEVCRSRKSRCDGTKPKCKLCLELGADCVYREPGIKLDAGDKLILERLNRIESMLQMTLPPNGIGLGGSPNLSNGTGHLSADGILTGGPFLSVMPNAALSQWATAPNISTMPKVHTNAALHLLQWPLIRELVSRPYDPQILLQLEMAREPLHSLTKTPCVDLSNTAAYIEAYFERVNVWYACVNPYTWRSHYRIALSNGFREGPESCIVLLVLALGQASLKGSISRIVPHEDPPGLQYFTAAWALLPGMMTSNSVLAAQSHLLAAAYLFYLVRPLEAWNLLCTTSTKLQLLLMSPSRVPSDQRELTERIYWNSLLFESDLLAELDLPHSGVVQFEENVGLPGGFEGDENEAVGRDDLWYFLAEIALRRLLNRVSNLIYSKDSMASTTSLEPVVAELDFQLTQWTIIYRPYILAVLDNEQAVLDPAVRDSCHKCLEASIRQLEHIAAHHAGHIPYLWQGALSIVSQTLLVMGATMSPSLSSILSTVVPHRETLDQILSEVIIEIERYAVLAPSLSLAADILKEAEVRRRAFLMSG

SEQ ID NO: 34 - protein, 699 aa, Nectria haematococca mpVI 77134
MSPSSTGESPHSASMTAAARPFAVPSRDSFSLEIPAASLTAMSNELGIKSPVTFKNQRTASFSRDTMLSSAQKPRHLSQSSENRTDTMTNGTQKLPSDEGSNPLKRRNTETGVDYPRRRATIACEVCRSRKSRCDGTKPKCKLCTELGAECIYREPGIKLDAGDKLILERLNRIESLLQMSMVSTSPNGLNLTQDSPGMSNGTGLSGDNLVMAVNPTNFVSIPNGGFGTWSAQPIGTNISTMPKVHTNAAMHLLQWPLIRDLVSRPYDPQILLQLEMAREPLHSLTKTPCVDLSNTQAYIEAYFERVNVWYACVNPYTWRSQYRTALSNGFREGPESCVVLLVLALGQASLHGSISRIVPQEDPPGLQYFTAAWSLLPGMMTANSVVAAQCHLLAAAYHFYLVRPMEAWNLLCTTSTKLQLLLMAPSRIPSHQKELVERIYWNALLFESDLLAELDLPHSGVVQFEENVGLPCGFEGEESEQAVGRDELWYFLAEIALRRLLNRVSQLIYSKDSIASTTSLEPVVGELDYQLTQWYESLPLPLQFPFTRTVLQDPIQTVLRLRFFACRTIIYRPYILAVLDNEQAVLDPAVRENCHKCLEASIRQLEHIHEHHAGHMPYIWQGALSMVSQTLLIMGASMSPSLLGILLTLVPHREALDQIINEVVLEVERYATLAPSLSLAAEIIKEAEVRRRAFLGTP

SEQ ID NO: 35 - protein, 760 aa, Neurospora crassa
MRTVQGSACAFPLPVTTAEIASHGCGRCKELDAPCVYDEPPAPHHRPRSSTTDTPPSDILSRLSALEDRINARGTEASRQHATQDDGDDIDAQEDTRESNGSSSNGPLDPPTMTGLPRSHQENVHVDGMGEVQLTDDGENCTYFGPSSNVALVRQLSLALTRAQSQTSRSRAMPTSATSLASSRYSSLQQPRSESGRQDPLNGGVKAGSRPGHHVPPEPEATNIIHEYFSTIGLFFPVIHQDSFMSTYNDLRKKGFMGARRVWLALLYMIIATVYRTNSPSTPSETSAETSERYFQWAKDLVMPQFLISSSLETVQLLCLMIEYLHGSSQSAQLWTLHSLAVKSALQIGLHSADASRHLTLLEREMRKRTWFLIFMNDNNLSAKFGRPMTIPPSLQKRLEPPLDINEHFPTMYASRAVIATSVDAFKCGVQLSHITCQLVSQLYDDNAGGSSLNHVNTFDTLRLAFDFSWKLSQWHQSVPPDLRPQNLTTETPPPVLESSSSSSSPSIEAQRLRAVLGLRYYGLCTLVERPVLLKFLGFQPEPGHGQGDVDTNVALLRESGVVSLRRCIRACRECIALAKAIVDRWQNQKVLLSGAWWLTAYHAFGASLTLYTVLLIAGTKPSFSNLLSDSELTTVRSALSDAVDLLSRFGENSLVISRCHDCLVNFLRAYDLVVVEQQRQQKQQQESQSTTVAATVQTSRNSDHTSSSQSLPPQGQGQGVHVNVIGDGNGVSLTSSSSSSSSSGGYCHEDQLPSSPAVI

SEQ ID NO: 36 - protein, 671 aa, Penicillium chrysogenum Wisconsin 541255
  VARIANT 58: Xaa = Any Amino Acid
MTLPPENETVDPIGDYAVSDTSIGKKKRSNTEAAEYPRRRATIAVRVSSLWHIRSRQXLTLIQCQICRLRKTRCNGARPKCQLCTDLNAECVYREPGIKLDAGDKLILDHLARIESLLHSNLPNQGPQLALPATSPATSNDTTIGSDDPSSKASSSGLPVHGKLSAVGLGSWVNLPASLSISTMPKMHTTPALHLLQWPLIRDLVSGACDPQHLLQLEMAREPLRLTPNSGFDLTNASTYAQAFFNYGNVWYACVNPYTWNRYYQSALAQGFQEGPMSCLVLLVLALGSASHSGSISFVSPDREPPGLPYFAAAWSFLPSVMMRNTVIAAQCMVMASAYLFYLVRPLEAWTLLSSVSMKLQLLFGSPNRIPSQWRELSVRVYWNALLFESDLLAELDLPHSGIVNFEELVDLPGGFEEEDEDDGDEEDGDHNEGEERRIARKYQGSSRPVDSQLAVRRDELWYFLAEIALRRLLNRVSHIIYQKDSTHTLASLGPIVSELDFQLSQWYDSLPRPVQFPLTPKPLSNPVQTVLRLRYNACRTIIYRPYILAVFENEQAGADPGVIECCRRCLDATLRQLEHITSHREGHLPYLWQGALSMVSQTLLIMGATMSPTLSILLPPVAQIDAIIAGVVNEVERYAHLAPSLKLSAEIIRDAETRRQICLRSANMCL

SEQ ID NO: 37 - protein, 598 aa, Phaeosphaeria nodorum SN15
MSQSSGTDREMSSDLTPPAQSNGTAPTSNGANGTHSEPRPSTKKRPSTDTIDYPRRRATIACRLCTELNAECIYREPGIKLDAGDKLILEHLNRIEGLLQTSITSGFSLSSHSPAVSNTTSEDFLARSSGTIPHLGMVQPINGIGTWTNHPSNISTMPKTHNTAALNLLASPMIRELVSRQYDAKILLQLEMTREPVSFSSSRGLDLSNTGTYVQAYFERVNVFYACVNPYTWSNHYQTALAHGFRDGPESCIVLLVLALGHAGSTGSITQQNPEKEPPGLAYFAAAWSLLPTVMTRNNMVAAQCQILAAAYLVYLVRPVEAWNVLSGASMKLQLLLSAPGRVSPAEEELGKRVYWNAVMIESDLLAELDLPHSGIAQFEEGFSLPTGFEDLGMEVVGRDELWYFLAEIALRRLLNRVSSMLYIRTTPYSKGPAATSVAQLDPLVVELDYQLNQWYAGLPQAMQFPLDRVPLQNPVQTVLRLRYFACRTIIFRPYVLLVLQDETLALDSSVQDNCHKCLEACRIMQDISLTCSKVLCPSLSQLLPPPSTMDDIINNVVLEMERYAHLAPSLRLSAEIIREAEGKRQMWLRTAGLKFEP

SEQ ID NO: 38 - protein, 706 aa, Podospora anserina S mat+
MSPSSNGDSPHSSTATMTAAASATVVGRFPLPNRDFTIEVPSPQLLAQVQINGGGVNSLKSPTSLKSARTPSFSREGILGSAQKARNLSQSSDNRPESNGMQKAPSDEGINPLKRRNTDAGVDYPRRRATIACEVCRSRKSRCDGTKPKCKLCTELGAECIYREPGIKLDAGDKLILERLNRIENLLQMNMVGHPNGMGMSHDSPNMSNGTALSGDNLMGIGSNAANFVSVIPSGGLGTWSATATNNISTMPKVHTNAALHLLQWPMIRDLVSRPYDPQILLQLEMAREPLHSLAKTPCVDLSNTNAYIEAYFDRVNIWYACVNPYTWRSHYRIALSNGFREGPESCIVLLVLALGQASSRGSISRIVPHEDPPGLQYFTAAWSLLPGMMTSNSVLAAQCHLLAAAYLFYLVRPLEAWNLLCTTSTKLQLLLMAPSRVPADQRELIERIYWNSLLFESDLLAELDLPHSGVVAFEENVGLPCGFEGDEQEAVGRDELWYFLAEIALRRLLNRVSQLIYSKDSMASTTSLEPVVAELDFQLTQWYESLPLPLQFPFTRTMLPDPVQTVLRLRFFACRTIIYRPYILAVLDNEQAVLDPSVREACTKCLEASIRQLEHITAHHAGHMPYLWQGALSIVSQTLLVMGATMSPSLSSILWSLVPHRDTIDQIINDVVMEIERYAVLSPSLSLSAEIIKEAEVRRRTYLSG

SEQ ID NO: 39 - protein, 712 aa, Pyrenophora teres f. teres 01
MAGITPSPDVSPVSSATTNGGFPRDAFSLNLSTLPDANSFILKSALTSPHLLDSPNGLFSGGGRLSNPFKKRPRNMSQSSGTDREMSNENTPPASNGIAPTSNGNDGSKAEPRPATKKRPSTDTIDYPRRRATIACEICRSRKSRCDGTRPKCRLCTELNAECIYREPGIKLDAGDKLILEHLSRIEGLLQSGLTSNYSLSSHSPAASNSTSDDFLARSTGHIPHLGMVQPINGIGTWTNHPSNISTMPKTHNTAALNLLSSPMIRELVSRQYDAKILLQLEMTRESVSLGTTRGLDLSNTGVYVQAYFERVNVFYAVVNPYTWSGHYQTALSHGFRDGPESCIVLLVLALGHAASTGSITQQNPDKDPPGLAYFAAAWSLLPTVMTRNNMVAAQCQILAAAYLVYLVRPVEAWNVLSGASMKLQLLLSAPGRVSPAEEELGRRVYWNAVMIESDLLAELDLPHSGIAQFEEGFSLPTGFEDLGTEAVGRDELWYFLAEIALRRLLNRVSSMLYIRTTPYSKGPAATSIAQLDPLVVELDFQLNQWYAGLPPAMQFPLDRVPLQNPVQTVLRLRYFACRTIIFRPYVLLVLQDESLAMDSGVQDNCHKCLEACVRQLEYITAHHAGHIPYLFQGALSIISQTLLIMGATMTPSLSQLLPPPATMDDIINNVVLEMERYAHLAPSLRLSAEIIREAEGKRQMWLRTAGLKFEV

SEQ ID NO: 40 - protein, 675 aa, Pyrenophora triticirepentis Pt1CBFP
MAAITPSPDVSPVSSATTNGGFPRDAFSLNLSTLPDANSFILKSALTSPHLLDSPNDLFSGGGRLSNSFKKRPRNMSQSSGTDREMSNENTPPASNGIAPTSNGNDGSNPEPRPATKKRPKLNAECIYREPGIKLDAGDKLILEHLNRIEGLLQSGFTSNYSLSSHSPAASNSTSEDFLARSAGHIPHLGMVQPINGIGTWTNHPSNISTMPKTHNTAALNLLSSPMIRELVSRQYDAKILLQLEMTRESVSLGTTRGLDLSNTGVYVQAYFERVNVFYAVVNPYTWSDHYQTALSHGFRDGPESCIVLLVLALGHAASTGSITQQNPDKDPPGLAYFAAAWSLLPTVMTRNNMVAAQCQILAAAYLVYLVRPVEAWNVLSGASMKLQLLLSAPGRVSPAEEELGRRVYWNAVMIESDLLAELDLPHSGIAQFEEGFSLPTGFEDLGTEAVGRDELWYFLAEIALRRLLNRVSSMLYIRTTPYSKGPAATSIAQLDPLVVELDFQLNQWYAGLPPAMQFPLDRVPLQNPVQTVLRLRYFACRTIIFRPYVLLVLQDESLAMDSGVQDNCHKCLEACVRQLEYITAHHAGHIPYLFQGALSIISQTLLIMGATMTPSLSQLLPPPATMDDIINNVVLEMERYAHLAPSLRLSAEIIREAEGKRQMWLRTAGLKFEV

SEQ ID NO: 41 - protein, 688 aa, Sclerotinia sclerotiorum 1980
MPYVGAMSVSSQDSPNSTTGSGRHFSMSRDKFDINIPSPQISLVSNGDLTSPTSLKSPGTRRIATFSREGILGSAQKARNLSQSSADRESIINGLQNRQNQNQNHNQNGNHNQNGHSDDGINPLKRRSTDAGIDYPRRRATIACEICRSRKSRCDGTKPKCKLCTELGAECIYREPGIKLDAGDKLILEHLTRIEGLLQSTLIGQTSNLALSTGSPSINGGTTTSGDDLMIAANGGFVSLLPATGLGTWTNPTNISTMPKIHTNAALHLLQWPLIRDLVSRPYDPQILLQLEMAREPLVLSKTPCLDLSNTSAYIEAFFAKVNVWYACVNPYNWNNHYRVALSNGFRDGPESCIVLLVLALGQASCSGSISRAVSSEDPPGLPYFAAAWALLPSLMTRSSVLSAQCTVLASAYLFYLVRPLEAWTLLSSTSTKLQLLLSAPGRIPPNQRELCERVYWNSLLFESDLLAELDLPHSGIVHYEEVVGLPGGFEQEDEDGVGRDELWYFLAEIALRRLLNRVSQLIYSKDSMSSTSSLEPVVAELDFQLSQWYESLPIPLQFPYTRTPLADPVQTVLRLRYFACRTIIFRPYILAVLDNEQAAMDPHAGHMPYLWQGALSIVSQTLLVMGATMSPSLSAIINSLVIHDTIDGIINDVVMEIERYAHLAPSLSLSAEIIREAEMRRRSYLGG

SEQ ID NO: 42 - protein, 710 aa, Sordaria macrospora khell
MSPSSNGDSPASVVGSMTMAAQAVPNAVRQYPLPNRDFTIEIPSPQLAPTVNGVNTIKSPSTLKSARAPNFSREGILGSAQKARNLSQSSENRPDNVNVSNGYQKAPSEESTNPLKRRNTDAGVDYPRRRATIACEVCRSRKSRCDGTKPKCKLCTELGAECIYREPGIKLDAGDKLILERLNRIESLLSINMGLASHTNGLGLSHNSPGMSNGTGLSGDNLMMQNPDAACFVSVIPSGGLGTWSATATNNLSTMPKVHTNAALHLLQWPMIRDLVSRPYDPQILLQLEMAREPLHSLTKTPCVDLSNTTAYIEAYFDRVNVWYACVNPYTWRSHYRIALSNGFREGPESCIVLLVLALGQASLRGSISRIVPHEDPPGLQYFTAAWALLPGMMTSNSVLAAQCHLLAAAYLFYLVRPLEAWNLLCTTSTKLQLLLMTPNRVPVDQRELSERIYWNALLFESDLLAELDLPHSGVVAFEENVGLPCGFEGDEQEAVGRDDLWYFLAEIALRRLLNRVSQLIYSKDSLASTTSLEPIVTELDFQLTQWYESLPLPLQFPFTRAMLPDPVQTVLRLRFFACRTIIYRPYILAVLDNEQAILDPSVREACTKCLEASIRQLEHISAHHAGHMPYLWQGALSIVSQTLLIMGATMSPSLNSILVSLVSHRDVIDQIINDVVMEIERYSVLSPSLSLSAEIIKEAEVRRRTFLSG

SEQ ID NO: 43 - protein, 568 aa, Trichoderma reesei
RPAARGTAFYPRKRANTACQVCRARKTKCDNKKPACSYCVSVGATCIQSPVDLSSFDPASLKILDRIDELERLLRHAVPIPGPEAAAPPSHPDDNMDISLLPQRVDHILQWPVFQNSGSHHHSPASYRAPPDAISTPPSGSASLAGLIDMDSHRIYRLLDNFFLHIHCKNPILDEVLARRMVINAFLDGIDWSPASCLALIICALGCIATPFGPSGETKLGTQTYNDSQIFFQAAQKRIGILLVRSDIVGAQCLFLSGVYLMMVFQPVYAWRFFSQALAACQHFPFLARAQNLNASLDSMEMGRQDTQEQAVYWSAWKSERELRQELDLPDFDILHSGSTLYPPFFPAPPIAPAESPDGPDSETQRARAAWLFYLAEISLRRLTSRLSREALDLRQRYSSDSVLLDMLLDMMPEYEAQIREWSESLPADLSIHTPVEEDGICRSVLRGRMINLLEQIYWPFVMASISAHATRRPVKPAVAEFAKRGLETHMHQVHVNKPGFHHRHHGSMFMIRACTRSALVLLAAAKAGCAMPTDWEDSVYKTVGMLAYWEDEDRDLIHWRSTLEREL

SEQ ID NO: 44 - protein, 517 aa, Verticillium albo-atrum VaMs.102
MASRDSFHIEVPSPSLTAVNGTHPLKSPSSLKNHRTPSFSRDGLISAVQKARNMSQSSDQRINGFSDMNKTPSDEGSNPLKRRNTDAGVDYPRRRATIACEVCRSRKSRCDGTKPKCKLCTELGAECIYREPGIKLDAGDKLILERLNRIESLLQMNMWPLIRDLVSRPYDPQILLQLEMAREPLHSLTKTPCVDLSNTTAYIEAYFDHVNVWYACVNPYTWRSHYRTALSNGFREGAESCIVLLVLALGQASLRGSISRIMPGEDPPGLQYFTAAWALLPGMMTSNNVLAAQCHLLASAYLFYLVRPLEAWNLLCTTSTKLQLLLMSPNRVPPNQRELTERIYWNSLLFESDLLAELDLPHSGVVQFEENVGLPGGFEGEEQEAIGRDDLWPYILAVLDNEQAILDPAVRDSCHKCLEASVRQLEHISAHHAGHMPYLWQGALSIVSQALLVMGATMSPSLGSILLTLCGSREAIDQIINDVVMEVERYSNLAPSLSLAAEIIKEAEVRRRAFLSG

SEQ ID NO: 45 - protein, 695 aa, Penicillium marneffei ATCC 18224
MSKRPHEDSVFSKTANFLERSASTPGNSISINELLSNSEEAEADHSETHARKPRNFIASVACENCRLKKTRCDESRPKCGLCKALNLECVYSERKLSKKDQSIGMIISTLHRIETKLENLPSVISNDIRPITGHVLQAVEAIQASASTTAAGTPSARTSSHKFSLSQNTSPAATNLLEAETQGSVDGKEIISFSQHGVVVWPGIIERLPHDFLSVYEQIGRNYVLDVELERPPLPMWVNSPFGLPNTGNWLEELPFALVKGLCEAFFSLFHPFTPFMDKHFFFSLTLGTVIKHGFSTTIETCLVLNVMALGCLAVRAYEEADFPLPGTMGDHFERPAWFEAVLEDPPGLSFFNEARKRMGFLMEKNNLSSCQYYLLSAMYYTQIIRPLDSGAMLNRAATCLCFMLANRDINYNEWEGDMKSRVFWNTVMYETILVQELDLPPSGLLSLEDNVPIPKFIPFKLSSEITRLPDPDESYYHQCHFLAQIANRIILTRIRHSLYLFSESGNLPRPAVSIELHKQVEEWRKNLPSVIQFSEKNSDTTLNDDRSPSISGTPRTPTSLAVLVADSMLRARYRICKFHIGRPYLYKALRTPNLLTDEDYEQIRSGLRFAMDWPMIRGVFRLMRSCIPIRFAFCSQFFGQLLIFHGIANSDEPRLRATLPPGWERWYDEMVEFLEYCSAYSPAISRDMDLVRLL

SEQ ID NO: 46 - protein, 603 aa, Talaromyces stipitatus ATCC 10500
MSYTRKRAALACIFCRSRKRRCDARKPSCSNCLDLDVECHYDDTPSQRIDTSGGSREILNRLRNIEAILQSQSERITALSNEPQRTPLHVHDAVTPRSQQSVAIVDMHSQTWSSSHLNAPSDYSSLPPLTIPVKHKTSSTYLLNLPAVKSLIGEYPTDLFFRFELRSHLPPQLSLEHSHAASPVNIQREITDELILFFFAYVHPNHPVLDREEFQKHYARFLENGPDHSYESILCMVVLALGAVVSTAPDPEVFKSSPPGMDYMQYAMPTLLSVSAWSFSSSMLAAHALVLASVYFAYIVRPLQSWRLIHSASTMLQINHVGVDSLQKISNGFNEGEHLVRLFWSSFLVECDRLAELELPRSGLEELTDSIYLPNCTNLGLAESAWYLAEISIRRLLNRIHNSLYPGKKQPLSKPPITSLASDDFSMEEIVSIDGICNELRSQLETWYLSIPEGLRPVLENANEEDTAGRQAILRIRYFAARHIIYRPFLLCVVTHGSKRAPRSMVEKAAICIESCRWYIHHTTKVLGRPSQYTWTFALSSLGAIIILTLGSLNRDLQAFVPDIDELQTMAIDNFRPWAFSSLEAVVSILEDIRKKRRLLLQV

SEQ ID NO: 47 - protein, 682 aa, Metarhizium anisopliae ARSEF 23
MNTSPDGLKVNQTLGAGRDKAHNPMSRSRLLFQPPDTAPATPLQLANSDGLLSSLKRKLSDCTVDYPRRRATIAVSKQSLCTSARFVSQMLTPYVDFHCRQCEVCRSRKSRCDGSKPKCKLCAELGAECVYREPGVKLDAGDKLILEQLNRIENLLQINLAANQGSGLHMSQSSSSTSNGTASGGDQALLSNSSNTAPTIPNGGLGTWVSVPTGTNISTMPRCHTNATMHLLQWPLIRDLVSTPYDPQILLQLEMDREPLHTLTKTPCVDLSNTQAYIQAYFDRVNIWYACVNPYTWRSQYRTALSNGFREGPESCIVLLVLALGDASLRGSISRIVPHQEPPGLQYFTAAWSLLPGMITTNNVLAAQCHLLAAAYLFYLVRPLEAWNLLCTASTKLQLLLMAPNRIPQKQRELVERIYWNTLLFESDLLAELDLPHSGVVQFEENVGLPGGFEGEEQGQARIGHDDLWYFLAEIALRRLLNRASQLIYSKDSVSSTTSLEPVVAELDYQLTQWYEGLPPPLQFPFSRTMLHDPIQAVLRLRFYACKTIIYRPYILAVLENEQAVLDPAVRECCHKCLEASVRQLEHVTEHHAGHMPYIWQGTLSMMAQTLLLMGSSMSPSLMGILLTIVPHQKALDDLINEVIMEVQNYASLAPSLRLAVEIIKEAELSNITNEARLLRLA

SEQ ID NO: 48 - protein, 677 aa, Neurospora tetrasperma FGSC 2508
MSPSSNSDSPASVVGSMTMAAQAAPNAVRQYPLPNRDFTIEIPSPQIAPTTNGVNTVKSPSTLKSARAPNFSREGILGSAQKARNLSQSSENRPDNVNVSNGFQKAPSEESTNPLKRRNTDAGVDYPRRRATIACEVCRSRKSRCDGTKPKCKLCTELGAECIYREPGIKLDAGDKLILERLNRIESLLQLNMGLTGHTNGLGLSHNSPGMSNGTGLSGDNLMMQNPDAAGFVSVIPSGGLGTWSATATNSLSTMPKVHTNAALHLLQWPMIRDLVSRPYDPQILLQLEMAREPLHSLTKTPCVDLSNTSAYIEAYFDRVNVWYACVNPYTWRSHYRIALSNGFREGPESCIVLLVLALGQASLRGSISRIVPHEDPPGLQYFTAAWALLPGMMTSNSVLAAQCHLLAAAYLFYLVRPLEAWNLLCTTSTKLQLLLMTPNRVPVDQRELSERIYWNALLFESDLLAELDLPHSGVVAFEENVGLPCGFEGDEQEAVGRDDLWYFLAEIALRRLLNRVSQLIYSKDSLASTTSLEPIVTELDFQLTQWYESLPLPLQFPFTRTMLPDPVQTVLRLRFFACRTIIYRPYILAVLDNEQAILDPSVRDACTKCLEASIRQLEHISAHILVSLVSHRDVIDQIINDVVMEIERYSVLSPSLSLSAEIIKEAEVRRRTFLSG

SEQ ID NO: 49 - protein, 708 aa, Aspergillus niger
MYRSSRHVEKLSTTLDEFRGVLDKLFPGIPAETLVNLPRDKLLELTGKGPSQMQTQAPHPASPATSASVEAHASPASSEDGNLESLQTIPDHTTDDRELKGSELTSTVSDDVNALSLSAKQPSSYLGVSSIHAVLKVIVWLEPSSLSHLSRAPATGVRRESVMDIASPEAQAWQVFGSQPHHGTSTHSPLQVPETQLLDAYFTYFQPFVPMLDEQYFRQTYLSARRKDKQWLALLNIVFALGSIAATPADDMSHQAYYMRSMSHLNLESLGSPHVETIQALGLMGGYYLHYSSQPNLAYSMMGAALRMAAALGLHKEVSDGQYGNGRNRLSSVDHKRRVWWSLFCLDTWGGMTLGRPSMGRLGPAITVKLPHYRETGNVLDLLPLLENVRFCKIATQIQEVLAVAPLTKPHEMAHLDSQLLEWYDNLPYILKDHEPCSESIAITRTVMKWRYYNQRMLLYRPTLLSYAMRRVPYIVLRSEERTAIERCREIAEATIQDVAAKAQFHQMSGWNAVWLIFQAAMVPLLGLFLNDGTVDDPRATAEACQAQVETTMLVLERLEPWSPAAKSTLEAVSRIFEAGKRGPSVIGEAHSINSGSCVTSTEETLGAVPGVSPMQVDFGRAIPHDSGFVDPFEPQFINDSAGQYLWDFLSWSDSNLLQGLADIDNVNNGPLFPQEERNAKYGSSDTAFFGGQLGDSTFFINSGPSFY

SEQ ID NO: 50 - protein, 626 aa, Coccidioides posadasii str. Silveira
MPDDSTESRTCRSPDLVAAVSDDVNALSLSTKRPSTYLGISSVNAVMRVIMWIDPESSQHFSRAPDPQPLPKREKQPLPDNCSWSLQPPPSTAGHLEVNPMELTNAYFAYFHSFAPLLDEHLFRETVLVRKRSDPRWLALQNIVFALGSIAAYTADDTSHESYYLKARHYLSLDTLGNPHLETIQTLALMGGHYLHYMSQPNLAHSLMAVALRMATVLGLHKEFIGNQEAASQNSQRKFSVDLRRRIWWSLFCLDTWGYMTLGRPSMGRWGPGITAKLPHNHGNKELAFYALSLVENTRFCKIATQVGDALAASPIVSYQEMVSLDNQLVEWYDNLPPLLKDHEPSADPVSTTRTVMRWRYQSQRILLHRPVLLSYAMRRIPYVALRTEERYAIERCRMVANETIRDVASTTRLNQMTGWNAVWLLFQATLVPLLGLFIADGTATHAHATSDSCRNQVETAIVALERLENWSPTAKRTLEVVSRILETSQRPRHTSVGSCTSGSDTHTAGMSDQSATASSETSNTAPSIHTMDQTAVLSNAAFPSYQNIAPYIQPSPQQMLDYITWGDNNIWSSVQEDFYTQQPPAVGMFGQGQQYLKPLDHEPPAVGERAGVYDNGLETPNIVRF

SEQ ID NO: 51 - protein, 653 aa, Nectria haematococca mpVI 77-13-4
MFHTFSSQTGDDPLPPGAEPEPPVRKVNSALDKATETLRRQAGVLQLLFPNHRLDELVDKDRADLIQLISPKPTRDHVNEERTLQSPDPLPTTGSSGLSGDIEDVPSSPEDLSIGESGEEERRWHESAQDPATIAASDDINALSLAGDQHRRSYLGITSVSAVLKSLFRLCPTAKDLAVEQSQTWPGVSEDETRPLVLNRTPGSLAAPDSLREQRYLGFYFEHIHAITPLIDEDSFRSTFTTGGGQSPAWLGLCNMVLTLGSIASGSDTAHIHYYHRARSYLDLDSLGSGNLESLQALCLLGGYYLHYRNSPNMAYAILGAAQRLAIALGLHRESPIRADHKDSEAGQRYVARIETRRRTWWSLYCLDTWASMTLGRPTCGRWDTNTMNTLPPTLLGPDDHCAVSLRESSRMCHICNRLQDRFAQSTRIDTHEARALDSELQSWYDSLPAILKDTTDAPPRITVAREFLRNRYYSVRMILSRCFLLYRAHEDIKRHTPNPAESQMIDLCRAVAAEAIDAIALHWVPNRIQVWNSAWYLFQACLVPLLSIAMETSSNSSDSEPETVMAWRTMLNKALEVFVDMKPWMRASDRTPDIVAVLFQAVSQGAEGIIRTPSVTDAGAHVFGWADEQWTEMDWSLFLGDEDISHNLFSFT

SEQ ID NO: 52 - protein, 731 aa, Penicillium chrysogenum Wisconsin 54-1255
MFIAFKAQNEEGLRNPKHKRRSERLSRRGSTPRACTSCRRRKIKCDGEKPCEACRWYKKPELCAYTEPRSSQQSQPEKLSIPSPDYKSTLERLFPDNAPENIAHFPRDKLLELVTAGGTPYSHHQDSSIAAGSLDTHNSTLSGEMPGLESLHTIPGEQLDENQCASASESVGHISDDVNALSLSARHPTSYLGVSSIQAALKVIAWLHPAVNTYFAQSLSKDQCSQPPNALPASRAAPQPDPPPTETQMLDAYFVNFQPFAPLIDEEAFRTTYLLGRRKDNRWLALLNMVLALGNITAAGADNNNHRVYFERSMDHLNLRSLGNPSLEVVQALGLMGGWYCHYTSQPNLAYSLMGASLRMAVTLGLQREPSDIHSMLDPKKSGIQEFKRRVWWSLCCLETWGHETLGRPSMDYFGPSITVNLPSRLDKESYFEVLPLTENVQFVKIALKIQESLAALPTLSHAEMFDLDAQLVRWWNDLPPVLKDYEPCPESLYAVRTVMRWRFYNHRMLLYRPTLLNYAMRRIPFMAIRVEERTAIQKCQEIAAISIQDIFSTTKLNQMVGWNAVWMLFQATMVPLICLSAGVADHDSAASFEACKTQVETAMLTLGRMKPYGHTAGRSLEVISGILESNLRGPMAAPVDANGDSLDPQNPQNPPNPQNFPPPNAFNAGQQISRDRVADWTATSFETLSSQYMWEYLSWDHSNLWPEVFDLNTQNDNVAMSFLNSPGGNR

SEQ ID NO: 53 - protein, 705 aa, Verticillium albo-atrum VaMs.102
MAPSIPIPTQGGMFHTCESSAAAAAAARLLLATWANIFQFRVLLPGSPKPLSRTMTRLLLRLLTTQITTAHASGETKRKDPCGQCLSSRAPKRCFYDKHRQRVIPSRKTLEALSQSLEECRSILKRLYPNQETQALLPLSRQELLSLLERPVLDTSIVTALPSPPLNTSPLSQELESPICSSSEQGLSSLEQMPGQDTEWDEERRGRDPIPIEADDVNALGLSVDRQSSYLGASSIKAALMCMLKVQPSLRTQLTTPLNTAEVAHNFPIRPQQLGPKENQRISWSWKGQTLLDAYFKRINVFIPMLDEAAFRAEYLEGQRCDSPWLALLNMVFAMGSITGMKSDDYNHVNYYNRAMEHLPLDAFGSSHIETVQALALIGGYYLHYINRPNMANAVLGAAIRMASALGLHRGESGPERQGNACELVCQPAVAVAHHRPVCRPLYIARCIMKWRYQNLRMLLHRPVLLSLASNTSSGVMLAHVAEQDIAAIETCRELAKQTIEDIAREWTRNQMSGWNAVWFLYQAAMIPLISVFWQWNSPRVSEWHKQIETILDLLEAMEDWSLSARRSREVVWRMYEASRQPSMRSESQSQSPVLHAMGSNEHGSILMAAEAELRMSPIGLEPEGMGMMGMLDQQGLWDLDGMFWGGASGDSSTDAQSHPHHQQQQPGSVDFGSFSVNEQMMHMDYNMIGTPASAVTMDGGFFVH

SEQ ID NO: 54 - protein, 575 aa, Verticillium albo-atrum VaMs.102
MFHTFGSTDPPASHLSPQVARPISRRVNKSCSECTRRKVKCDGRVPCTSCQYYKTSESCVYRQRTKRQAVSKRAFSTLEQVTEQMQVQQRILNTLFPHNSPEDLVGRSRTELLQLLSTASPSDTSVCNISPEPLRPSPQYFLSGTGGTDVSDGSTQASEAGDTVQERRWDESAQQPAEIGASDDINAISLATDQHRPSYLGVTSMSAVMGALFRLCPAAKARTIEFSKELTKEQHPPHQQASDLISGPNLPALNQLREQRCVEFYFEHIHAITPILNEEEFRRTYIGGTRQDASWLGLLNMILTLGSIASGSNTLHVQYYKQARVFLDLDSLGSGNMESLQALCLLGGYYLHYRNSPNMAYAVLGAAQRVAIALGLHRDSSRRTHDQGADTNQENLLRIETRRRTWWSLFCLDTWASMTLGRPTCGRWDNTTMDTQPPSLLSPDDHCAISLRSSCQFCHICNRIQHRFAQLRRMSAIEALAFDQELRDWLYGTTSFDRHGDGMEAGLVPRKGGPMVCKPDKGFGHIQRHEAVDEGIGSSSPHGGYPLSGCHGDGRESGSPINQSGRGLGVTRLVR

SEQ ID NO: 55 - protein, 781 aa, Aspergillus clavatus NRRL 1
MFHTFEGFENPGASAQTKPRGERQPSVSRRVTTLRACTSCRHRKIKCDGEKPCEACRWYKKADQCHYSDPRPSRRHVEKLSTTLDEYRSILERLFPSTSPEVLVSLSREKLLELSGKGPSQQQAHHPASPATSSSVEAHVSPISEEDGNLESLQTMPEESNDSRNRSSDDITNAISDDVNALSLSARQPSSYLGVSSIHAVPKVIVWLDPGSLSYFSRTPPVAPRRDSVRDYPAGSEDQNWHIQSSQQHPITPPQTQMQVTEVQLLDAYFTWFQPFVPMLDEQVFRETYLSGCRRDDRWLGLLNIVFALGSIAACSSDDMSHALYYQRAKSYLNLDSLGSSHLETIQTLGLAGGYYLHYTSQPNLAYSLMGAALRMAAALGLHKEFSDSPDGSNKEKILAMDMKRRTWWSLFCMDTWGGMTLGRPSMGRLGPTITVKLPNHRESGNVLDILPLLENVRFCKIATQIQEVLAVAPLTKHAEMAHLDSLLLEWYGNLPSILKDHEPCSESIMNTRTVMRWRYYNQRMLLYRPTLLSYAMRRVPNIALRSEERTAIERCREIAEATIQDISSTVRSHQMSGWNAVWLVFQATMVPLLGLFLNDPTASDPRASFQSCQSQVETAMLLLARLQPWSRTAKRTLEAVSRILEASKRGSDMGGAPNGVSGGNLPDRESLVSGMMPGNALAQTDSGRSVGIANDGSMMDPMAAFMDDSAGQQLWDFLSWSDSTIWPGFAEADNANEMSFAQDEKNAKYGSNAPGFFGSPMTDSTYYMNSSVPFYSHAQP

SEQ ID NO: 56 - protein, 715 aa, Aspergillus clavatus NRRL 1
MFHTFEIHRNEQRTARDERRGRRPGLRACKECRRRKIRCTGTHPCEPCLYYKKPELCRYSDPRVPRRTLDDSIDTANQYRSVVEQLFPSAPVQSLVSLSREELLALLRDSILVSDGPTPQLPETPGTDQNSHPSQDDSLENTDGNESNDVSDDVNALSTVTRAPSTYLGISSINAVFQVLKWIDPESLELAAAVEETPSPGPAGGRSPSLTKLTNSVIPQSHSTQSNNDLQLLDAYFDYIHPSMPLVDERDFRQTYLAGTRQDDQWLALLNMVLALGSIALYPGDDPSHIVYCKRVRSYLSLESLGTAHLETVQTLGLMAGHYLHYISQPNLAYVLIGAAVRMATALGLHKENADIDESESRPLRPSVPVELRRRIWWSLYCLDTWGSMTLGRPTLGRSSLAVTTRPPVQTVGINSSCTLILVENIRYCQIATRIQEALAASPLIPYSQLQDFDNELLDWYEQLPALLKSYEPCSDSIYTARTRMQWSLHNLRILLYRPVLLSFALRRVPYVALHTEQRLAIDKCRMLANDAIRDIAQARIHNPTAAWGVIWHLFQATLVPLLSLSVVLTNTAPITDADRELVLSCREQVEITIGTISRIEAWHPTARKSLSLISRILAATKVRFADPPPPIYHPQTQPPNQPQSQSQPHSQAMNPALQVPVMTGMPSIYTENELSLPSQEVWDYISWTGHRAWPDTLASQVPNPDFWSAPGWWQ

SEQ ID NO: 57 - protein, 771 aa, Aspergillus flavus NRRL3357
MFHTFEGFENPNNSAPVRGRGERQPSVGRRVTTLRACTSCRHRKIKCDGEKPCEACRWYKKADQCHYADPRPSRRHVEKLSTTLDEYRGVLEKLFPNIQPENLVSLPREKLLELMGKPSLLQTQPPHPASPATSASVEAHVSPVSNEDGNLESLQTMPEESSDSQNSGYTEISNNFSDDVNALSLSSRQPSSYLGVSSINAVLKVILCLDPGALSYFSHPSTNTDSRDSALGYSPAEAQPWPVQESQQPITPPQPHRPVTEMQLLDAYFTYFQPFVPMLDEEVFREVYHSGCRKDERWLALLNIVLALGSIAACPSDDMSHTIYAQRCKSYLNLESLGSSHIETIQTLGLLGGQYLHYVSQPNLAYSLMGAALRMAAALGLHKEFSDNQEGSCKQNIYSTDLKRRVWWSLFCLDTWGCMTLGRPSMGRFGPTITVKLPQYRERGNVLDIIPLLENVRFCKIATQIQEILAAAPLTRYHEMSHFDNQLLEWYENLPYILKDHEPCSESIIITRTVMKWRYYNQRMLIYRPTLLSYAMRRVPYIALRSEERTAIERCRQIAEATIQDISSTAQSHQMSGWSAVWLIFQAVMVPLLGLFLNDNTTNDPRATVASCQSQVEMAMLVLARLEQWSPTAKRTLGAVSQILEASKRGTNMANEAGLVNSMFAVSREGAVPRAASGFHPSQNIFLQNEAGFDPFAPPVIDDSTAQYLWDFLSWSDSSLWPGITDTNSFNDETLFAQTDKTMKYPNNGAAFMGGSMGDGAYYANPPLPYY

SEQ ID NO: 58 - protein, 777 aa, Aspergillus terreus NIH2624
MFHTFEGFENPAGSTVSRGRNERQQSVGRRVTTLRACTSCRHRKIKCDGEKPCEACRWYKKAELCHYSDPRPSRRHVEKLSTTLDEYRGVLEKLFPNMSPEALFNLPREKLLEMTTTGATAHGQVQGAHPASPATSASVEAHVSPMSNEDTNLESLQTMPDESSEARNSANSEATNGISDDVNGLSLSARQPSSYLGVSSINAVLKVIVWLDPGSVTYFSRTPAMGARRGSIVDLSAPEAQNWPVQAGQQQQPVTPPQQVPVTDVQMLDAYFTYIQPFIPMLDEQSFRETYMSGQRKDDQWLALLNVVFAMGSIAACPSDDTTHQTYYQRAKGYLNLECLGSSHLETIQALGLLGGYYLHYVSQPNLAYSLMGAALRMAAALGLHKEFTEGQDANNKQKVSSMDLKRRIWWSLFCLDTWGGMTLGRPSMGRFGPTITVKLPHHRENGNVLDILPLLENVRFCKIATQIQEVLAVTPLTRYQDITHFDNQLLDWYENLPYILKDHQPCSESITIARTVMKWRYANQRMLLYRPTLLSYALRRVPYIALRSEERTAIERCREIAEEAIQDISSTAQSHQMSGWNAVWLIFQAVMVPLLGLYLNDSTNNDPRATVESCQAQVETAMLVLARLQPWSPTARRTLDAVSRILEASKRGPDPMINDAGNMPNGNPCPTSVPGAAPSILLSQHELPRGMNLDSGFADSMAPAFMDDSAGQHLWDFLSWSDNSLWPGVTELDGTVEDILMMPDDKGAKFGNGPSAFFGNPMGEPTYYANTALPFY

SEQ ID NO: 59 - protein, 732 aa, Aspergillus terreus NIH2624
MFHTFDGSESASRAAPGRQGPGGERGETTGRRVTTARACTSCRHRKIKCDGERPCEACRWYRKADQCHYAHPRTSDSKRVKEVSATLDTYRRVLGTLFPNVNVESLDNLPREKLLEVLAAQSQQSPGSIPQPSSSPTATLASVATHGDSTEDDNLELLQTMPAEPLDRQHTGSTDPDQGLSDDVNGLALCARQPSSYLGISSTQAVLKVIVLLNPGCASYLSRKPTSAGEGTAYGAPSGWLPHAPVAPLQPQHLPLTEMQFLDAYFLIFHAFCPMIDEKSFRETYLAGHRRDKPWLALLNIVLALGSVAATNPNDTTHQIYYQRCEENLGLSALGNPQIEIIQTLGLISGWYCHYLSQPELAQSLMGAALRMATARGLHKEPIKHDQVLDPATAASLDIKRRTWWSLFCMDTWAGMTLGRPSMGRTGLTITVKPPHGRDEETLMDVLPLVENIRFARIATEIQELLAAAPLGKHQAAQMDAQLLEWWENLPAILKDYEPCPERIKTVRNVMRWRYYNQRILLYRPTLLSYAMRRVSYLALRTEERTAIEKCREMAELSIQHIAATAQTNQLGGWNAVWWTFLASMVPLLGLFINDPTATDPRASIRSCQAQVETAMLTFARMHALGHTAKTSLDAVSRIFEASKHVDNLAVHGAALPVLAPAVDSVRRDATALGVMPQPEMNRAMTSHSEAAHLDALIYPFVHDANDQQMWDYLSWGDNSMWPGLVTDIAMA

SEQ ID NO: 60 - protein, 631 aa, Aspergillus terreus NIH2624
MEVARAQVLHGAASYSALNKATETVRRQAAVLQVLFPHVTLDDLVDKDRAELIRLLSQSSSTNADLPAERFVVASSVSDSPENDPSALEESDEADDSEDRHWDESAKDPATLATSDDINAIGLAGDRRRRSYLGICSVGAVLKALFRLCPGAKECIIEDSKLWAPVQPDDTRPALLPQGLAMTPLLDSLRELRYITFYFDNVHAITPFLHEESFRAKFTIRDQQGSSWLGLCNMVLTVGSIASGSDTAHIHYYNQARSYLDLDSLGSGNLETLQALCLLGGYYLHYRNSPNMAYSILGAAQRLAIALGLHREPPTRNEQPNPETRGSYALRLETRRRTWWSLYCLDTWASMTLGRPTCGRWDTATMNTSLPCTLHSEDHFATSLRASVEFCHICNRLQHRFAQFIRISVHEAQALDYDLQRWYDGLHPVLQHTTDAPPRMSVAREFLRNRYYNARLILSRCFLLYMAYEDTKRRHPHSAEQQMAGMCRSIAGETIDAIALHWVPNRTQVWNAAWYLFQACMVPLLSIAMANTSDHAAVDPADVSAWYASLHKALEAFSEMRPWMRASDRAPNIVAVLLRAVSQGPDGSIHTPSVTDGALNLFGMSDEFLIEMDWSELPNDENMFQSLFPLT

SEQ ID NO: 61 - protein, 780 aa, Mycosphaerella graminicola IPO323
MYHTFQAAPSFPASGDGSKGPRPPGSSSSRRISTTNACIECRRRKIRCDGNQPCGQCNWYQHPELCAYSKPAQRVIPSRKLVERLQSQVEQYHSLFARLFPGKELENILTMSREGLVNLAVTLPAAKLSPPSAEARDRHQVKSETVESETADSLEALEQAPEQDSTSGESRKLHAKIQAISDDVNGLSLSIDKASSYTGVSSINAAMKVILKTAPFAWAFISQPSAQTSNPSRATTPPPHVRDPDPYYLPSADVGEKLIESYFKYVHVQMPMVDEEQFRHGYLYGTRRDPAWLSLLNMVFALGSLASSTCDNEEHIAFFQRARKHLIAESFASSSLFVLQAFGLLSGYYLHWLNRPNEAIAIMGGTLRMATALGLHREYGHGKPDKGTGGEISADIRRRTWWTLYVLDSLGSLSTGRPSLGRSGPGITTEVPRIPEQMNNAQYLASLRLLPIIHNISFCKIATKVQDQLAARTLIEFGELFAIDAELEKWREDMPPILRDRDWTSCPEMLKIPRAVMYWRYQNLRILMHRPVLLAAALRKTPFANMKDDERLAVSRCRLVAGQSIYDIDASCPENLIAGWNAVWMVYQAVMVPLVSLEGSAPLPGSDDDVEKWKSEIETAIAFFDRMNQWSVAARKSRDVVQRLYNATSFIDQPSAQLHQKVQNREQSALPSTGLQQQSKTIQPAEVDFSAGRPIPLDPSEYQPQENSARQGWDVTTSSGAAVIPDEFFWNDMMWDTLPQNMPDLPPNLGEGIDVVDWWQNGYDTGPDAQSWSQWPQDGT

SEQ ID NO: 62 - protein, 772 aa, Neosartorya fischeri NRRL 181
MFHTFEGFENPGASTPAKGRERQQSVGRRVTTLRACTSCRHRKIKCDGEKPCEACRWYKKADQCHYSDPRPSRRHVEKLSTTLDEYRSVLEKLFPSTSPEALVSLPREKLLELSGKGPSQAHAQHPASPATSVSVEAHVSPISNEDGNLESLQTMPEDPSDSRNQSTSDITNGISDDVNALSLSAKQPSSYLGVSSIHAVLKVIVWLDPGSLSYFSRTPASAAPQESMHDYSTAAEHQNWHIQSSQPHPVTPPQAHMQATDMQLLDAYFTWFQPFVPMLDEQAFRETYLSGHRRDDRWLGLVNIVFALGSIAACPSDDISHKIYYQRAKSYLSLDSLGSSHLETIQTLGLMGGYYLHYVSEPNLAYSLMGAALRMAAALGLHKEFSYSQDASGKQKISAMDLKRRTWWSLFCMDTWGGMTLGRPSMGRLGPTITVKLPNHRETGNVLDILPLLENIRFCKIATQIQEVLAVAPLTKHAEMSQLDSQLLEWYENLPSILKDHEPCSESISNTRTVMRWRYYNQRMLLYRPTLLSYAMRRVPYIALRAEERTAIEKCREMADTTIQDISSTAQSHQMSGWNATWLIYQATMVPLLGLFLNDATASDPRASVQSCQSQVETAMMVLARMQLSSPTAKRTLEAVSRILEASKRGSDMGGAASGLASGSCAQGRESNMSGMMPGVVSALTEPGRGVAIANDGGMVDPMAPPFMDETTGQQLWDFLSWSDSTILSGFSEIENPNDMKCGGNAPGFYSPMTDSTYYMHPSVPFYSLAQP

SEQ ID NO: 63 - protein, 701 aa, Neosartorya fischeri NRRL 181
MFHTFELRHSNPRTATGEQRRGRRPGLRACKECRRRKIRCTGTHPCEPCLYYKKPELCRYSDPRVPHSGTRDHGSHPDSQYRSVLERLFPSVSLQSLASLTREELLDLLRDSILGSDRPPPQPPERPGEEHSRSSLEAISMGNADTGEVNAVNDKDDVSDDVNALSMATRPPSTYLGISSINAVLKVISWVNPESMARPFTTTPSRNRPRVKTRAPVTPSTESQARDQLIDAYFNFIHPSMPLLDETDFRQTYVSNTRRDEHWLALMNMVLALGSISLYPSDDTTHITYCKRARQHLSLESLGSAHIETVQTLGIMAGHYLHYISQPNLAYVLIGAAVRMATALGLHKETADTDASESRPLQSSSVPVDLRRRIWWSLYCLDTWGCMTLGRPTLGRSSTAVSTKPPANTSTTLILLENIRFCQIATRAQEALAASPLPPYAQLQDLDTELTNWYAQLPPLLKTYEPCPDSVHTARTIMRWSLHNLRILLYRPFLLRYALRRVPAITLHTEERLAIEKCQVLARQAIRDIAETQVKSPPAAWGVIWHGFQASLVPLLMLSILAAEAENDVDIEMVESCREQLEVAMAAIARVEAWQPTARPSLDLIAGIFRASLARLGLMAASGASSDGTSPVAPGRVYPVDLQPRVQVPQTVPMAYTGNELGVSSQDVWDYISWVSPTAWTDVQGQASTMDLWSTPGWWQL

SEQ ID NO: 64 - protein, 704 aa, Aspergillus fumigatus A1163
MFHTFALRHSNPRAATGEERRGRRPGLRACKECRRRKIRCTGTHPCEPCLYYKKPELCRYSDPRVPHIGTRGNGSHADSQYLSVLERLFPSVSLQSLASLTREELLDLLRDSILGSDRPPSQPPEGAEDHSRSSFEAMSTGNADSGDVNAVNDKADVSDDVNALSMATRPPSTYLGISSINAVLKVISWVNPESIARPFTTAPLRNKPRPKAQVSRPPSTDCHAPDQLIDAYFNFIHPFMPLLDETDFRQTYVSNTRRDEQWLALMNMVLALGSISFYPSDDTTHITYCKRARQHLSLESLGSAHIETVQTLGIMAGHYLHYISQPNLAYVLIGAAIRMATALGLHKETADTDASESRPLQSSSVPVDLRRRIWWSLYCLDTWGCMTLGRPTLGRTSMAVSTKPPASTPDTLILVENIRFCQIATRAQEALAASPLPPYAQLHDLDTELADWYAQLPPLLKTYEPCPDSIHTARTIMRWSLHNLRILLYRPFLLRYALRRVPAIMLPSDERPAIEKCQQLARDAIRDIAETQVKSPAAAWGVIWHGFQASLVPLLKLSILAAEADGHDVDMEMVESCREQLEAAMAAIERVEAWQPTARPSLDLIAGIFGASMARLELMAVSTASSDGRTSPVAPERGYPVELQPRVRVQVPQSGPMAYMESELGVVSEDVWDHISWMSPTAWDDGQGQASVMDLWSTPGWWQL

SEQ ID NO: 65 - protein, 737 aa, Aspergillus fumigatus Af293
MFHTFEGFENPGASAPAKGRERQQSVGRRVTTLRACTSCRHRKIKCDDEYRSVLERLFPSTSPEALVSLPREKLLELSGKGPPQPHAQHPASPATSASVEAHVSPISNEDGNLESLQTMPEDPSDSRNQSTSDIANEISDDVNALSLSAKQPSSYLGVSSIHAVLKVIVWLDPGSLSYFSRTPASAAPRESMHDYSTSAEHQNWHIQSSQQRPVTPPKAHMQATDTQLLDAYFTWFQPFVPMLDEQAFRETYLSGHRRDDRWLGLLNIVFALGSIAACPSDDISHKVYYQRSKSYLSLDSLGSSHLETIQTLGLMGGYYLHYVSEPNLAYSLMGAALRMAAALGLHKEFSYNQDASNKQKLSAMDLKRRTWWSLFCMDTWGGMTLGRPSMGRLGPTITVKLPNHREAGNILDILPLLENVRFCKIATQIQEVLAVAPLTKHAEMSQLDNQLLEWYENLPSILKDHEPCSESISNTRTIMRWRYYNQRMLLYRPTLLSYAMRRVPYIALRSEERTAIEKCREVADATIHDISSTAQSHQMSGWNATWLIYQATMVPLLGLFLNDATASDLRASVQSCQSQVETAMMVLARMQLSSPAAKRTLEAVSRILEASKRGSDMGGAASGLASGSCAQGRESNISGMMPGLVSALTEPGRGVAIANDGGMVEPMAPPFMDETTGQQLWDFLSWSDSTILSGFSEFDNPNDIKCDGNAPGLYGSPMTDSTYYMHQSVPFYSLGQP

SEQ ID NO: 66 - protein, 704 aa, Aspergillus fumigatus Af293
MFHTFALRHSNPRAATGEERRGRRPGLRACKECRRRKIRCTGTHPCEPCLYYKKPELCRYSDPRVPHIGTRGNGSHADSQYLSVLERLFPSVSLQSLASLTREELLDLLRDSILGSDRPPSQPPEGAEDHSRSSFEAMSTGNADSGDVNAVNDKADVSDDVNALSMATRPPSTYLGISSINAVLKVISWVNPESIARPFTTAPLRNKPRPKAQVSRPPSTDCHAPDQLIDAYFNFIHPFMPLLDETDFRQTYVSNTRRDEQWLALMNMVLALGSISFYPSDDTTHITYCKRAHQHLSLESLGSAHIETVQTLGIMAGHYLHYISQPNLAYVLIGAAIRMATALGLHKETADTDASESRPLQSSSVPVDLRRRIWWSLYCLDTWGCMTLGRPTLGRTSMAVSTKPPASTPDTLILVENIRFCQIATRAQEALAASPLPPYAQLHDLDTELADWYAQLPPLLKTYEPCPDSIHTARTIMRWSLHNLRILLYRPFLLRYALRRVPAIMLPSDERPAIEKCQQLARDAIRDIAETQVKSPAAAWGVIWHGFQASLVPLLKLSILAAEADGHDVDMEMVESCREQLEAAMAAIERVEAWQPTARPSLDLIAGIFGASMARLELMAVSTASSDGRTSPVAPERGYPVELQPRVRVQVPQSGPMAYMESELGVVSEDVWDHISWMSPTAWDDGQGQASVMDLWSTPGWWQL

SEQ ID NO: 67 - protein, 704 aa, Aspergillus nidulans FGSC A4
MFIAFEATKDANASKDLESGPRNPKSVTGRTSTGRRGVVPRACSSCRRRKVKCNGEKPCEACRWYKRPEECTYPEYERLRNMKSSPSPDYRSTLTRLFPGTAPEQLVNLPREKLLELMTGSASQMQDSPSTTASVTTGVSVMPIERPSLESLHSIPRDELGEIPNVPSASSSGQISDDVNALSLLARPPTSYLGISSVQAALKAIAWNLPGYNFSISPTVPRQQPEEPLSPLSTTLATLQFTETQLVDAYFANFHSFAPLLDEDAFRKTHRAGYRQDARWLALRDTVLALGSIIAAVDVNDRTHCTYFESAMSRLNLGSLGNPSLEVVQTLGLMGGWYCHYTSQPNLAYSLMGASLRMALTLGLHRELCDGRSVHDPAQAAHEEFRRRVWWSLCCLEIWGQETLGRPGMDFFTASITVNTPRLIDKDNYIEIVPLIENVEFVKVASKIQESLATPPALTHTEMCDLDTQLLQWWNNLPPILRDSEPYPESIYSVRTVMRWRLYTQQMLLYRPRLLNQTMRRIPFLAVRADERTAIRRCRELAETVILDIAQTTSMNRMIGWNAVWFIFQATMVPLICLSGIPVDNDLEASADSCKRQVETAILALQRMRPYSPTAGRTFEVISNLFGAILQGTGDPPPDADSDAPMDMAMPERVPVANDYNSEQAPRSRPVDEAAGFFDNLPPEYGYTSFGTPVTRCLDMSIIP

SEQ ID NO: 68 - protein, 741 aa, Glomerella graminicola M1.001
MFHSFDSRRSPSASAAAAPTLPRKVNRSCQECTRRKVKCDGGHPCASCQYYKVADSCEYRQRSRRHAVSRSTLEKTAEKLRDQSRVLQELFPDVSVDDLLGKSRAELLALLPRDSLSGTRPAVPQAGLLPAGVVSTAAPEEDGNEDEDDVPDDPTQLSESGEAANDRRWEESAHQPTTIRASDDINAVSLATDQHHSSYLGVTSVSAVLRAIFRLCPAAKEHTAQRVKTWNDAQNQSQLLPSLSPAGAGAGQNPLRERRCIVFYFDHVHPITPILNEDDFRRTLASGARHDGSWLALLNMVFTLGSVASGSDSLHLHYYKQARAHLDIDFLGSGNMESLQALCLLGGYYLHYRNSPNMAYAVLGAAHRVAIALGLHREPAPRSRIADERPVSDAERDTRVSRAETRRRTWWGLFCLDTWASMTLGRPTCGRWDGSTMDTLLPASLFPDDHVAASLRASCMFCHICDRIQHRFAQHARLSAQEALAFDRELREWHASLPEYLRDPANSPPRLAMAREFMRNRYLSVRLILSRCFLLYLAQSHGLRRGAASVSSIAEPSAEDMMLVDICRSVALEAIDAITLYWMPNRIHVWNSAWYLFQACMVPLLSIAIETRHRHSSCQQERPAVRPIPSLATAGMPPVAPLATWCAGLTKALEVFAEMRPWMRTSDYTPEIVAALYEAVTAEIEEPGAAVGPATRTPSATTDGSMDLFEWCDEQLAELDWGTYLGVGGEDGMHQRMFAFF

SEQ ID NO: 69 - protein, 812 aa, Neurospora crassa; identical to SEQ ID NO: 4

SEQ ID NO: 70 - protein, 803 aa, Sordaria macrospora k-hell
MAPSISIPTQGGMFHTFQGVTPRKPSVDSQDSVKSSGSGAAKRITTPHACAECKRRKIRCDGQQPCGQCLSSRAPKRCFYDKHRQRVIPSRKTLEALSQSLEECRSILKRLYPNQEVHALLPLSRQELLDLLDRPVPDNAGNGLPSPPLNTTSMADLNSPIKSENILEQIPTRDTEWDEERRERDHIPAEADDINALSLSVDRQASYLGASSIKAALMVMLKVQPGLRSSLAAPLNSVEISHNFPAIRQKSSTQKDPQRIPWSWKGQTLIDAYFKRVHVFIPMLDETTFRADYLEGQRFDAPWLALLNMVFAMGSIVAMKSDDYNHVNYYNRAMEHLPMDSFGSSHIETVQALALIGGYYLHYINRPNMANAVLGAAIRMASALGLHRESLTQGGSDMVAAETRRRTWWALFCLDTWATTTMGRPSFGRWGPAINIRPPEFGVNSGRDSSQHAGILPMIENIKFCKIATQIQDMLAISPLLRTEDRCNLDGQLVAWYNNLPWLLRTTDPCAEPLYMARCIMKWRYQNLRMLLHRPVLLSMASSGLNPHTQACDSDLAAIETCRELAAATIEDIGREWTRNQMSGWNAVWFLYQAAMVPLVSIFWQWGNPRVPEWLKQIEAVLEFLEAMEEWSLAARRSREVVLRMYEASRVIQAQGAAAHQLQQRRSQSPHSVNGTGPLGMHINTDLLMGSPDSAELHMSPIGLEPVEGLGMMGMLDQGGMWDLDGMFWGPSPSPPHHGHHPTHPDDAVATAADFAAAFPTADGADGLLHHHSAIEYGNLMGHHHADAHTGQGQFGGVDGYSY

SEQ ID NO: 71 - protein, 822 aa, Podospora anserina S mat+
MEIYKSASAPHVLASLRHYPHLSLSNFGLSNMAPSIPVPTQGGMFHTFQGVTPRKQSTDSQDSTKTSSTGTAKRITTPHACAECKRRKIRCDGQQPCGQCLSSRAPKRCFYDKHRQRVIPSRKTLEALSQSLEECRSILKRLYPTQDVQSLLPLSRQELLSLLDRPTIDTSVGGLPSPPLNTSPMSDLDSPMMPKTENLLEQMPSRDTEWDEERRGRDPIPAEADDINALSLSVDRQTSYLGASSIKAALMVMLKVQPGLRNSLAAPLNGVEMSHNYPAIRQKPTTQKDPQRIPWSWKGQTLIDAYFKRIHAFVPMLDESTFRADYLEGQRTDAPWLALLNMVFAMGSIAAMKSDDYNHINYYNRAMEHLPMDAFGSSHIETVQALALIGGYYLHYINRPNMANAVLGAAIRMASALGLHRESITVGLPGSDIIAAETRRRTWWSLFCLDTWATTTMGRPSFGRWGPAINIRPPEFGINANRDSSQHAGILPLIENIKFCKIATQIQDMLAITPLLRTEDRCAIDAQLVNWYTSLPWLLRTTDPCAEPLYMARCIMKWRYQNLRMLLHRPVLLSLASSGLNPHTQACDADLQAIETCRELAAATIEDVGREWTRNQMSGWNAVWFLYQAAMVPLVSVFWQWGSPRVPEWLKQIEQVLDLLEVMEEWSLAARRSREVVWRMYEASRAVQAQGAAARSQSPAGLHITTTADSIVVGGGEVHMSPIGLEPVDGMGGMMGLLDQGGLWDLDGMYWGGNGPQSPTHTGNPDDSAAAAEFAAYAAAQQAASAAHHHHPELMQHVDYGMMHHHHAGHHHVGMEGFGYVQ

SEQ ID NO: 72 - protein, 797 aa, Chaetomium globosum CBS 148.51
MAPTIPVPTQGGMFHTFQGVTPRKASTDSQDSTKTSGSGTAKRITTPHACAECKRRKIRAPKMCFYDKHRQRVIPSRKTLEALSQSLEECRSILKRLYPNQEVQALLPLSRQELLNLLDRPVIDTSVGGLPSPPINTSPISDIGSPMMTKSENILEQLPSRDTEWDEERRGRDPIPAEADDINALSLSVDRQASYLGASSIKAALMVMLKVQPSLRNTLAAPLSGVEMSHNFPAVRQKSSAAPKDPQRIPWSWKGQTLIDAYFKRIHVFVPMLDESAFRADYLEGQRTDAPWLALLNMVFAMGSIAAMKSDDYNHINYYNRAMEHLPMDAFGSSHIEMVQALALIGGYYLHYINRPNMANAVLGAAIRMASALGLHRESLAQSSSDIIAAETRRRTWWSLFCLDTWATTTMGRPSFGRWGPAINIRPPEFGINANRDSSQHAGILPLIENIKFCKIATQIQDMLAITPLLNTEDRCNLDSQLVAWYTSLPWLLRTTDPCAEPLYMARCIMKWRYQNLRMLLHRPVLLSLASSGLNPHTQACDADLAAIETCRDLAAQTIDDIAREWARNQMSGWNAVWFLYQAAMVPLVSVFWQWGSPRVPEWLKQIEAVLDLLEVMEEWSLAARRSREVVWRMYEAARQLVAQQRASASPSIQVLTGGGAAGAEGMLMASPGSAEAAGMHMSPIGLEPVDGLGLMGLLDQGGLWGDLDGMYWGSQHSHSGSMSLGSPVDESAMAAAAAHEFAAAAAYHPGAPTTAGPHEGMVHAVDYGGLMGHHAHPHHGGHHHHQAAAMEFGYVQ

SEQ ID NO: 73 - protein, 751 aa, Glomerella graminicola M1.001
MAPSIPVSTQGGMFHTFQGVTPQKQTSDSQESGKSAGSNTSKRITTPHACAECKRRKIRCDGQQPCGQCLSSRAPKRCFYDKHRQRVIPSRKTLEALSQSLEECRSILKRLFPNQDIQSLLPLCRQDLLSLLERPVLVTATALPSPPLNNSPLSQELESPVCSGSERGFSSLELMPGRDTEWDEERRARDPIPIEADDVNALSLSVDRQSSYLGASSIKAALMCLMKVQPALRNSLTTPLHSAEVMHNFPSLRQKSAVTKDTQRVPWSWKGQTLIDAYFKRIHVFVPMLDEAAFRADYLEGQRFDGPWLALLNMIFAMGSIVAMKSDDYNHINYYNRAMEYLPIDAFGSSHIEMVQALALIGGYYLHYINRPNMANAVLGAAIRMASALGLHRESLAQGSSDVVAAETRRRTWWSLFCLDTWATTTMGRPSFGRWGPAINIRPPEFGVNQTRDSSQHAGILPLIENIKFCKIATQIQDMLAISPLLRTEDRCNLDGQLVNWYSSLPWLLRTTDPCAEPLYIARCVMKWRYQNLRMLLNRPVLLSLASNGSLSQVGEQDITAIETCREIAKHTIEDIAREWTRNQMSGWNAVWFLYQAAMIPLVSVFWEWNSPRVPDWHQQIETIIDLLEAMEDWSLAAKRSREVVWRMYEASRQPSVRSESPLQGMSSDQGLLLAESELHMSPIGLEPEGMGMMGMLDQHGLWDLDGMYWGQSPDQSVDFTPYTVNEQMMHMDYGMMGSQTATIGGDFFIH

SEQ ID NO: 74 - protein, 781 aa, Magnaporthe oryzae 70-15
MAPATSPAPTQGMFHTFQGVTPRKQTSEAPGSPKAANPVSNSKRITTPHACAECKRRKIRCDGQQPCGQCLSSRAPKRCFYDKHRQRVIPSRKTLEALSQSLEECRSILKRLYPSHDVQSLLPMSRRDLLDLLDRPILDTTAAALPSPPLNTSPLSDEIQPPLFIKPDQVLSSLEQMPSRDAEWDEERRERDAIPAEADDVNALSLTMDRQASYLGASSIKAALMVMLKVQPGLRSTLSAPLNTGEMPHNYPSTKSRAGTHKDPQRIPWSWKGQTLIDAFFKRIHVFIPMLDETTFRADYLEGQRFDAPWLALLNMVFAMGSIVAMKSDDYNHVTYYNRAMEHLPMDAFGSSHIETVQALAIIGGYYLHYTNRPNMANAVLGAGIRMASALGLHRESLTQSAGDVLVAETRRRTWWALFCLDTWATTTIGRPSFGRWGPAINIRVPEFGINAARDSTHHAGILPMIENIKFCKISTQIQDMLAVSPLLRTDDRCHLDAALVDWYANMPWLLRTTDPCAEPLYIARCVMKWRYQNLRMLLHRSVLLSLASSGSTHAAEHDIAAIETCRDLAQQTIEDIAREWTRNQMSGWNAVWFLYQAAMIPLVSVFWQWNSARVPEWHKQIETVLELLDAMEDWSLAARRSREVVFRMYEASRNLQRQQQHHRSQSPADSTTSSHHMGMTGGRTSPRLIIGPSADTAVEMPHMSPIGIVDPESIMGMMGVSDQQSLWDLDGMLWGQHDEFDAGAYGFHDNMMMSMDYNMMGNDIPATTAAALDHGYPYVH

SEQ ID NO: 75 - protein, 829 aa, Verticillium albo-atrum VaMs.102
MYHNFQIEGGPQPASASQLGGLDASDTKTVKVSKACAECKRRKIRCDGQHPCRQCISTRVPKKCFYDKHRPRVVPSRKYVTPLQILLCGSSIVDRGAPQLLTRACRRVLENLSQSLEECRSVINRLFPNQEIFDLLPLTREELLELLRHPTKPHDEAVLPSPPANPSPLEDDEESLDQEVEPGAAELEQMPTKDSEWDEERREHEPIPVESDDVNALSLTMDKRASYLGASSVKAVLMVMLKLKPQLRNALATPRNMAAATGAIAVQPEAMRRASAVESKPAAKVPWTWRGQTFVDAYFKRVHAFIPMLDEASFRADYSLGQRVDSPWLALLHAVLAMGSIAATKSSDLHHEQLYQQAMTHLTIDSFGSSRVETVQALAIIGGFYLHYINRPNMANAILGAAVRMASALGLHRESLAQGLSETDVLAAEIRRRTWWSLFCLDTWATTTMGRPSFGRRGPGINIRSPELGISQAAESAQHAGVLPMIENIKFCRIATQIQDTLAASSLPSTDDRQSMDTQLVTWYESLPWLLGTTQPCAEPLYIARCVMKWRYQNLRMLLHRPVLLTWAASQQRPVPARSHRRASHAPSSVSSSADAGTSPGSGVLNDEEILASINTCSDMAAQTIEDIAKEWTRNQMLGWNAAWFLYQAAMIPLLRLCWQPGNAEVETWRSQIETTLEILDAVGDWSLTACRSREVVRRVYEASCQNEEVQPSLTAAAKLMGANPVAQGDMSNLYGSTGGMGQTAEDFDFRMSPIRLDTDMEVAAFMEQDWMWDLDGMFWGQQPGTNPQQQQQHPQQHASLQMHDTNVLYGDGMTVMPMHYNMDNMNNG

SEQ ID NO: 76 - protein, 647 aa, Nectria haematococca mpVI 77-13-4
HACVECKRRKIRCDGKQPCDRCQSRRSQSRCVYDHHRQRIVPSKRVLDELSQNLQDCRSVLSRLFPGHDVSSLLPLSRQELCQLLDQPSSQSTEPIETLPSPALSMSKIQLLDVQQIPAGDTEWDEERRERDPLPAEADDVNGLSLTLDRQASYLGISSIKAAFGVMVKIQPQLRTSLASLQRNGSKRTLELPSPQTGQLEETAPIPWTWKGQLLIDNYFKGLHVFTPMLDEVSFRADYLGGQRCDAPWLSLLNMVFAMGAIMATKSSDLDHFKFYEKAMKHLSMGAFGSSHIETVQALALLGGYYLHYVNRPNMANAILGATIRMASALGLHREPMAGDNINTALVEMRRRTWWSLFCLDTWTTTTMGRPSFGRCDPSIDIQPPQISIDQERDSAQHAGIMPLLENIQFCKIATQIHDMLAATSQQTAESLQHLDGLLVGWYDKLPSILRNRESCAEPLHLARCVIKWRYLNLRMLLCRPILLAVASSDKDAPISEDDLAAIATCQELARQTIDDVASGWTKHQMSGWNAVWLLYQAAMIPLLSILWQPQSPSVADWQAQIEKTLEVLEAMEDWSLTARCSRDVVKRIYEASRQLSGQNEGVSAVESDRLPEFMEEDFYAWAEGLELDHMVNMLDQEWQWDIGPGQ

SEQ ID NO: 77 - protein, 734 aa, Botryotinia fuckeliana B05.10
MQVLSTEAKKIPLSTYFCHIPYRVDKAALAVINLQVIPDPNPIRNLSRWVGYCPSDIGSHFHAFINWFNKDVSYLTLDALSQSLDECRTVLRRLFPDQEMQQLLPLSRNELVALIDRSPRSALSIASPSASNTSPTSQEYRSPLNSGSDECRSLANLEQIPNQDIEWDEERRNRDPIPTEADDVNALSLSVDRQSSYLGATSIKAALLVMLKVAPRLRSLFLAPSNNRQISASSNYPTPRPGSSAKDLQAISWSSNGQTLIDAYFNRVQIFVPMLDEPTFRADFLSGRRQDAPWLGLLNMVFAMGSIVASKSDDHNHINYYNQAKDHLGIDSFGSGHLETLQALSLMGGLYLHYINRPNTANAICGAALRMACAMGLHRESMHENSTESNLIAEQRRRTWWSLFCLDTWASTTLGRPSMGRWGHAITMQPPESTLNTNQNMNITPLVENIKFCKVATQIQDALAQTPLLRNDDLTNLDRQLVEWYDNLPWILRSTEPCPESIHTARCVMKWRYQNLRMVLYRSVLLNLANRGNQGISPTKEELAAVQTCRKIAQESIEDISREWTPNQMLGWNGVWFMYQASMIPLVSMFWESWNTNLVRIWQSQIEVVLEAFDGMADWSLAAKRSREVVSKVYEVSKRPLTRQPSPGLGHMTDDMNRMGGIDGRNYMDSDMLQQVEIMGEEQLMMLDNGGIWDLDGMLWGNLPDGLDMPYDGLPMQYDDSGMAQFEGPYIFHQ

SEQ ID NO: 78 - protein, 787 aa, Pyrenophora teres f. teres 0-1
MFHTFQSSVSVRSPGGDSDNAARPSRPPGSRRISTSNACVECRRRKIRCDGTQPCGQCQWYQHPEACGYSKPAQRVVPSRKLVDKLSNNLDLYKTILTKLYGTQNLESLATLPREELLELALSSTVANSTTSPSAPDSQTCSEAQAGSDGAESLEALEQAPPEDPYWDEARKHQLRVQGISDDVNGLSMSVDRLSSYVGVSSITAALKVIVRCAPQARSFISNNNQETALPSRASSPPPGLTDDRPDALPPPEHGQQLIESYFDRVHPFFPLIDERKFWSTFLYSNRSDSPWLALLNMVFALGSLSSQAADNEAHHIYFTRSRKHLSLESFGSGNLEVLQALAIMSGYYMHYLNRPNEAHSLMGGTLRMATALGLHREYSERSDASQQAKSVNEEDSISPEMRRRIWWSLFCLDSWASTTTGRPSLGRMGPSITVMRPGTAANAVQTIPPPNSPQYIQQLKILPIIHASAFCQIATKIQDRLVECPLLSSVEMASYDAQLVKWHEDLPSILSKTDEPCPNFLRRTRLVMKWRFQNIRIILHRPMLLTTALRHASWASLSADEKVSVGKCRLVACKTIEDISRDCMPDLISGWNAVWFCFQACMVPLVSLFSDPSVPEEVEKWKASIETALNFFEAVKDWSIAAKKSKDAVARLYAAYKTQASTLSQRTQTPVSHMPYPQQYQQPGHTQIHTHFPVPGTSNGPAMINPQTTNYGQQHQPPFIQYNPATPGWVNTGNDPAILNNFWDDMMWDTNLPDMLETPFGIATDYEYVGAAQDPGPGGACWMHGN

SEQ ID NO: 79 - protein, 976 aa, Leptosphaeria maculans
MQPSRMLQTAATYDAGSTSTRTLDDFVVLVFMPAEAPREEEIACARIVPYVSGTYTILAVLAHDEASHVSLFRGHESPSSKGRSSGDLLERAANMTYADFQCQSRLALRGNSSRPPVSNGRLSLLVHQAYDDTAPALGTRGDFPLTILRPADDMPTTKTLPAALIYQPCIVGIANLTEQEKVWVVDTGDFDTSSCSTSQHDMFHTFQSSAAMRSPDADIDASGKPSRPPGSRRISTSNACVECRRRKIRCDGSQPCGQCQWYQHPEACGYSKPAQRVVPSRKLVDKLSNNIEQYKAVLTKLYGGRNLESLANLPREELLELALSSPSITLTTSPSTTESVALSDVQAGSDGAESLEALEQAPPEDPYWDEARKHQLRVQGISDDVNGLSMSVDRLSSYVGISSITAALKVIVRCAPQARLLIAHNSQETALPSRAGSPPPELADNNPLAVPSAQHGQQLIEAFFDRVHPFFPMIDERKFWNTYLYGDRKDSAWLGLLNTVFALGSLSSSTADNEAHYVYFTRARQHVSLESFGSGNLEVLQTLAIMSGYYMHYLNRPNEAHSLMGGTLRMATALGLHREYSERSGSSRKFTAAGEEDSISPEMRRRIWWSLFCLDSWASTTTGRPSLGRMGPSITVMRPGTAPNAVQTIPPPDSPQYIEQLKILPLIHASAFCQIATRIQDRLVETPLLSLAETAAFDMQILKWHEELPSILSDLNEPCPDFLRRVRTVMKWRFQNIRLVLHRPVLLTTALRRSSWNSLSPEEKVAVGKCRMIAAKTIQELSKECMADLISGWNAVWFCFQACMVPLVSLFSDCSIPEEVKKWNESLETALQFFETAKDWSIAAKRSGDAVTRLYAAYKTYASTMLSQPQAPMQTVQPHYQDSNNFALPGTVTTSSMLNTHQIYSQAQPAFQYNPSTPTWANANDPTILNNLWDDMMWDTNLPDMLETPFGLNNDWEYASTAQDSGSGGACWMHGN

SEQ ID NO: 80 - protein, 777 aa, Aspergillus niger CBS 513.88
MFHTFEGFENPTLPAAVRGRNQRQQSVGRRVTTLRACTSCRHRKIKCDGEKPCEACRWYKKADLCQYSDPRPSRRHVEKLSTTLDEFRGVLDKLFPGIPAETLVNLPRDKLLELTGKGPSQMQTQAPHPASPATSASVEAHASPASSEDGNLESLQTIPDHTTDDRELKGSELTSTVSDDVNALSLSAKQPSSYLGVSSIHAVLKVIVWLEPSSLSHLSRAPATGVRRESVMDIASPEAQAWQVFGSQPHHGTSTHSPLQVPETQLLDAYFTYFQPFVPMLDEQYFRQTYLSARRKDKQWLALLNIVFALGSIAATPADDMSHQAYYMRSMSHLNLESLGSPHVETIQALGLMGGYYLHYSSQPNLAYSMMGAALRMAAALGLHKEVSDGQYGNGRNRLSSVDHKRRVWWSLFCLDTWGGMTLGRPSMGRLGPAITVKLPHYRETGNVLDLLPLLENVRFCKIATQIQEVLAVAPLTKPHEMAHLDSQLLEWYDNLPYILKDHEPCSESIAITRTVMKWRYYNQRMLLYRPTLLSYAMRRVPYIVLRSEERTAIERCREIAEATIQDVAAKAQFHQMSGWNAVWLIFQAAMVPLLGLFLNDGTVDDPRATAEACQAQVETTMLVLERLEPWSPAAKSTLEAVSRIFEAGKRGPSVIGEAHSINSGSCVTSTEETLGAVPGVSPMQVDFGRAIPHDSGFVDPFEPQFINDSAGQYLWDFLSWSDSNLLQGLADIDNVNNGPLFPQEERNAKYGSSDTAFFGGQLGDSTFFINSGPSFY

SEQ ID NO: 81 - protein, 663 aa, Gibberella zeae PH-1
MRGQEEAFIPWIDKYGELLRVCGIHENVGTSEYARPFSTVTPPFISSLSTDLMSPHAHRMRKEVYAHAKIASAERTLEDLSKSLEERDSILARLFPNRDISDLVSLSDQELRDIVLNAGPSPNGTTLTFRSDHTPNESITQDSQWDEDRRERDPLPAEADDVNALSLPLDRQASYLGISSIRAALGAILQMRPQLRASLASRQESYNETSSLRDNGMQCTQMVQSPTENPCVKWSRKGQALVDVYFKRIHIMTPLLDETSFRTTYLSSNRHDSPWLALLNMVLAMGSIAASKSSDREHYKYYTNAMRHLDISAFGSSQIETLQALAIVGGHYLHYINRPNRGNAILGAAFRMASALGFHREPSDQDKEGDQLQVVELRRRIWWCLVCLDTLASMTLGRPSFGRFCPSIDIQPPKFSTGGHGQLDSEPDMDIMLLAENIRFCRIATEIQDKLTVTPFLKPSDRDRFDDMLISWFDSLPSLLGDDQECDELVHLGRSLLDAASKPGVYSQPADQDAIEKCQLLSKTAIEDIAQSWKNDQMSGWNAVWHLYQAVMIPLLSMVWQPQNPAVSEWKSQIEMVLGLFESMRDWSLTARCSKRVVSQIYETIPICCNAERLQLGSFDMERSSHMIRLSHSSQYRDSSFMERVKVLLINLKTAEALKIGSS

SEQ ID NO: 82 - protein, 771 aa, Aspergillus oryzae RIB40
MFHTFEGFENPNNSAPVRGRGERQPSVGRRVTTLRACTSCRHRKIKCDGEKPCEACRWYKKADQCHYADPRPSRRHVEKLSTTLDEYRGVLEKLFPNIQPENLVSLPREKLLELMGKPSLLQTQPPHPASPATSASVEAHVSPVSNEDGNLESLQTMPEESSDSQNSGYTEISNNFSDDVNALSLSSRQPSSYLGVSSINAVLKVILCLDPGALSYFSHPSTNTDSRDSALGYSPAEAQPWPVQESQQPITPPQPHRPVTEMQLLDAYFTYFQPFVPMLDEEVFREVYHSGCRKDERWLALLNIVLALGSIAACPSDDMSHTIYAQRCKSYLNLESLGSSHIETIQTLGLLGGQYLHYVSQPNLAYSLMGAALRMAAALGLHKEFSDNQEGSCKQNIYSTDLKRRVWWSLFCLDTWGCMTLGRPSMGRFGPTITVKLPQYRERGNVLDIIPLLENVRFCKIATQIQEILAAAPLTRYHEMSHFDNQLLEWYENLPYILKDHEPCSESIIITRTVMKWRYYNQRMLIYRPTLLSYAMRRVPYIALRSEERTAIERCRQIAEATIQDISSTAQSHQMSGWSAVWLIFQAVMVPLLGLFLNDNTTSDPRATVASCQSQVEMAMLVLARLEQWSPTAKRTLGAVSQILEASKRGTNMANEAGLVNSMFAVSREGAVPRAASGFHPSQNIFLQNEAGFDPFAPPVIDDSTAQYLWDFLSWSDSSLWPGITDTNSFNDETLFAQTDKTMKYPNNGAAFMGGSMGDGAYYANPPLPYY

SEQ ID NO: 83 - protein, 767 aa, Penicillium chrysogenum Wisconsin 54-1255
MFHTFEGFENPTAATPARNRSTSERRESISRRVTTLRACTSCRHRKIKCDGEKPCEACRWYKKSDQCHYSDPRPSRRHVEKLSTTLEEYRSILGKLFPNFSPESLVNLPREKLLELTIAPSGSHMQTQSHHADSPSTSVSMEAHVSPLSNEDDNLEALQTMPEELPDSRNTSSSDLVEGVSDDVNGLSLSARQPSSYLGVSSIQAVIKVIVWLDPGCASYFSRTPVNEQEDAIGWPHRAPVTPPQPLIPPSEMQMLDAYFLYFQAFAPMIDERSFREAYCAGRRRDDHWLALLNIVLALGCIAATGPDDTTHQTYFLRCKSHLTLTSLGSSHIETIQALGLMGGWYCHYISQPNLAYSVLGAALRMSVALGLHKEFAETRQIPSPAKLASMDLKRRVWWSLFCMDTWAGMTLGRPSMGRIGSNITVKPPLCRDKGNVLEILPLVENIRFAKIATQVQESLAAAPLVKHQEMAHADAQLLEWWDNLPSVLKDHEPCSESINTVRTVMRWRYYNQRILLYRPTLLSYAMRRVPYIALRSEERTAIEKCREVADESIRNIAATAQLNQLCGWNAVWWTFQASLVPLVGLFLNDPTANDPRASIESCQAQVEMAMMTLARMQSFGHTAKRSLDAISRIYEASKRGQDLGDPDSSASVLSSTNPYPAGRDMSVMFPAPEQGRGNVAMGENGFLDPLATTPFADDSGGQYLWEYLSWSDNNLWPGIVTDVDGRNDMMTLLTPDHEKGPKFGEQPAYFDPMPDPGYFANGGFYY

SEQ ID NO: 84 - protein, 737 aa, Aspergillus fumigatus A1163
MFHTFEGFENPGASAPAKGRERQQSVGRRVTTLRACTSCRHRKIKCDDEYRSVLERLFPSTSPEALVSLPREKLLELSGKGPPQPHAQHPASPATSASVEAHVSPISNEDGNLESLQTMPEDPSDSRNQSTSDIANEISDDVNALSLSAKQPSSYLGVSSIHAVLKVIVWLDPGSLSYFSRTPASAAPRESMHDYSTSAEHQNWHIQSSQQRPVTPPKAHMQATDTQLLDAYFTWFQPFVPMLDEQAFRETYLSGHRRDDRWLGLLNIVFALGSIAACPSDDISHKVYYQRSKSYLSLDSLGSSHLETIQTLGLMGGYYLHYVSEPNLAYSLMGAALRMAAALGLHKEFSYNQDASNKQKLSAMDLKRRTWWSLFCMDTWGGMTLGRPSMGRLGPTITVKLPNHREAGNILDILPLLENVRFCKIATQIQEVLAVAPLTKHAEMSQLDNQLLEWYENLPSILKDHEPCSESISNTRTIMRWRYYNQRMLLYRPTLLSYAMRRVPYIALRSEERTAIEKCREVADATIHDISSTAQSHQMSGWNATWLIYQATMVPLLGLFLNDATASDPRASVQSCQSQVETAMMVLARMQLSSPAAKRTLEAVSRILEASKRGSDMGGAASGLASGSCAQGRESNISGMMPGLVSALTEPGRGVAIANDGGMVEPMAPPFMDETTGQQLWDFLSWSDSTILSGFSEFDNPNDIKCDGNAPGLYGSPMTDSTYYMHQSVPFYSLGQP

SEQ ID NO: 85 - protein, 773 aa, Aspergillus nidulans FGSC A4
MFHTFEGFENPAASAPARAGRERQSSIGRRVTTLRACTSCRHRKIKCDGEKPCEACRWYKKADLCHYSDPRPSRRHVEKLSTTLDEYRTVLEKLFPGASPEALANLPREKLLETLAQPQAQPPSTGARQISPATSTSHEAHVSPISTEDGNLESLQAMPEESNDPRNLSSEITNTISDDVNALSLSTRGPSSYLGVSSINAVLKTIVWLDPGSAAYFASTPPSAPRRGSVADLSSSEGQSWAAHDQPGTPPQVHLQVPESQLLDAYFTYVQPLTPILDEQSFRETYAAGHRKDDRWYCLLNIVLAMGSICASTCDDISHKIYYSRCRAYLDLESLASLHLETVQTLGILGGWYLHYVAQPNLAYSLMGAALRMAATMGLHREFADQSDTSNKQKMAQLDLRRRVWWTLFLMDCWGGVTLGRPTMGRFSPAITVKLPHYRESGNVLDILPLLENVRFCKISNQIQDALAVSPLTKYSEILHFDTQLVEWYNSLPYILKDHEPCPEGIANTREVTKWRYHVQRILLYRPTLLSYAMRRVPYIALRSEERTAIERCREIAETAIRDISATAKTPQMSGWNAVWFLFQSTMVPLLGLFINDNTVTDPRATTEACQAQVQDALLVFARLQQASPTARKTLDAVSRIFEASKRGPGIAAETNSINSANLSPTSREAGVLNTPGILPSHNDGRGFAVTHDSSFTDPFAPSTMDDPNGQYLWDFLSWSDTNIVPMADVENINDGGLLGSDDKHFKYTNTSFFGNQLTEPPFFTNSSIPYYS

SEQ ID NO: 86 - protein, 794 aa, Coccidioides posadasii C735 delta SOWgp
MFHIFEGFENPDKARSQSREGRGKSGKRSSTVRACEQCRRRKIRCDGEQPCEACQWYKKTDLCHYSDPRPSRRYPLPVFIRSFSLKSWHVEKLSSTVEEYRVVFEKLFPSIPLQSLSNLPRERLLELASRTQPQSEILPVPVSKPPPSVDNHVLPLPPEDENLESLQTMPDDSTESRTCRSPDLVAAVSDDVNALSLSTKRPSTYLGISSVNAVMRVIMWIDPESSQHFSRAPDPQPLPKREKQPLPDNCSWSLQPPPSTAGHLEVNPMELTNAYFAYFHSFAPLLDEHLFRETVLVRKRSDPRWLALQNIVFALGSIAAYTADDTSHESYYLKARHYLSLDTLGNPHLETIQTLALMGGHYLHYMSQPNLAHSLMAVALRMATVLGLHKEFIGNQEAASQNSQRKFSVDLRRRIWWSLFCLDTWGYMTLGRPSMGRWGPGITAKLPHNHGNKELAFYALSLVENTRFCKIATQVGDALAASPIVSYQEMVSLDNQLVEWYDNLPPLLKDHEPSADPVSTTRTVMRWRYQSQRILLHRPVLLSYAMRRIPYVALRTEERYAIERCRMVANETIRDVASTTRLNQMTGWNAVWLLFQATLVPLLGLFIADGTATHAHATSDSCRNQVETAIVALERLENWSPTAKRTLEVVSRILETSQRPRHTSVGSCTSGSDTHTAGMSDQSATASSETSNTAPSIHTMDQTAVLSNAAFPSYQNIAPYIQPSPQQMLDYITWGDNNIWSSVQEDFYTQQPPAVGMFGQGQQYLKPLDHEPPAVGERAGVYDTGLETPNIVRF

SEQ ID NO: 87 - protein, 757 aa, Coccidioides immitis RS
MFHIFEGFENPDKARSHREGRGKSGKRSSTVRACEQCRRRKIRCDGEQPCEACQWYKKTDLCHYSDPRPSRRHVEKLSSTVEEYRVVFEKLFPSIPLQSLSNLPRERLLELASRTQPQSEILPVPVSKPPPSVDNHVLPLPPEDENLESLQTMPDDSTESRTCRSPDLVAAVSDDVNALSLSTKRPSTYLGISSVNAVMRVIMWIDPESSQHFSRAPDPQPFAKREKQPLPDNCSWSLQPPPSTAGHLEVNPMELTNAYFAYFHSFAPLLDEHLFRETVLVRKRSDPRWLALQNIVFALGSIAAYTADDTSHESYYLKARHYLSLDTLGNPHLETIQTLALMGGHYLHYMSQPNLAHSLMAVALRMATVLGLHKEFIGNQEAASQNSQRKFSVDLRRRIWWSLFCLDTWGYMTLGRPSMGRWGPGITAKLPHNHGNKVGDALAASPIVSYQEMVSLDNQLVEWYDNLPPLLKDHEPSADPVSTTRTVMRWRYQSQRILLHRPVLLSYAMRRIPYVALRTEERYAIERCRMVANETIRDVASTTRLNQMTGWNAVWLLFQATLVPLLGLFIADGTATHAHATSDSCRNQVETAIVALERLENWSPTAKRTLEVVSRILETSQRPRHTSAGSCTSGSDTHTAGMSDQSATASSETSNTAPSIHTMDQTAVLSNAAFPSYQNIAPYIQPSPQQMLDYITWGDNNIWSSVQEDFYTQQPPAVGMFGQGQQYLKPLDHEPPAAGERVGVYDTGLETPNIVRF

SEQ ID NO: 88 - protein, 714 aa, Uncinocarpus reesii 1704
MFHIFEGFENPDKARSQSREGRGKAGKRSSTVRACEQCRRRKIRCDGEQPCEACQWHVEKLSSTVEEYRTVFDKLFPSVPLQSLLNLPREKLLELASNAQSHPESSPVPASASKYSPSAENHVSPLPPDDENLESLQTMPDDTTESQGSSSSDLLATVSDDVNALSLSTKRPSTYLGISSVNAVMRVITWIDPESSQHFSRTSNRQPRSKQEKVAPRDGSGWALPLQAPQRGPFGIFALGSIAAYTANDTSHEGFYLRARHYLSLDTLGNPHLETIQTLALMGGHYLHYISQPNLAHSFMAVALRMAIMLGLHKAFADNHNDASLGNQRKFSIDLRRRIWWSLFCLDTWGYMTLGRPSMGRSGPGITVKLPQYNGTRELALCVLSLVENTRFCKIATQVGDALATSPIVAYSELVGLDDQLVEWFDKLPPVLKDHEPCPDPVLTTRTVMRWRYQSQRILLHRPVLLSYAMRRVPYVALRTEERYAIEKCRMVADETIRDVASTTRLNQMTGWNAVWLLFQATLIPLLGLFIADSTATHPYATLDSCRNQVETAMCALERLESWSPTAKRTLEVVSKILEASQRPRTTVTSSFISGSQASSAAVSLNTPNSSPPVHNMNQVPVLGGTGFQGYQAIAPYMGNTPQQMLDFISWGDNTSIWPSAQEDFYPPPATTVELLGHSEHYLKSLGHSATVTGAREAMYDAGLPPTQNVVRFS

SEQ ID NO: 89 - protein, 749 aa, Talaromyces stipitatus ATCC 10500
MFLTFESSQANKTGLRNPKKQISPTSITTRRSERLNRRRTTPRACTSCRQRKIRCDGEKPCEACRWYKKAELCSYPERERGMGRERNSQEEPAHSSSDYRKALERLFPETAPENIVHLSREKLLGLISKSSAAGSQHHDSMTIATSASVETRHSTLSIERPAGLESLHSIPGEQQKRIHLDDETQCIDGSEEESIEHISDDVNALSLPARNLTSYLGVSSIQAALKVIAWLHPELDSHLSRLSSKDQRRQHHRHQEQPGVLPTEEQMLDAYFTNFQSFAPLIDEDTIRSTFLSNRRKDDKWLALLNIIFALGSITAAGVDNHNHRTYYERSKSYLNINTLGNPSLEVVQTLGLMGGWYCHYISQPNLAYALMGASLRMAVTLGLQREPPLDRNLPVIGTGYQEFKRRVWWSLCCLETWGHETLGRPSMDFFSPSITVNLPRVLDKENYIKILPLIENVHFIRLASKIQDSLAALPTKTYSEMLTLDSQLVAWWNNLPPVLKDCSPCPESIWPVRTVMRWRFYNQRILLYRPSLLNYAMRQIPFVAVRDEERVVVQRCCEIAKMAIEDISGTTTSTIGMNQMIAWNAVWLVFQATMVPLIFLSTCSTAAAATQDDGEVESCKVQVQTAISTLDRMRVYGHTAERSLEMISAILDTVLGISTVRAYNSAGLNENIESQNLPPMTEHQPITRDRVLDWTAAATTSSSFDNFSSQHMWEYLSWGESNDLWPELYTNLDPQDSQIEGADFFNSN

SEQ ID NO: 90 - protein, 642 aa, Pyrenophora tritici-repentis Pt-1C-BFP
MFHTFQSSVNVRSPGGDSDNAAKPSRPPGSRRISTSNACVECRRRKIRCDGTQPCGQCQWYQHPEACGYSKPAQRVVPSRKKQRYQAGQVLRHLDSQMTDQTHYHLPEHGQQLIESYFDRVHPFFPLIDERKFWSTYLYNNRSDSPWLALLNMVFALGSLASQAADNETHHIYFTRSRKHLSLESFGSGNLEVLQALAIMSGYYMHYLNRPNEAHSLMGGTLRMATALGLHREYSERSDASRQTKGVSEEDSISPEMRRRIWWSLFCLDSWASTTTGRPSLGRMGPSITVMRPGTAANAIQTIPPPNSPQYIEQLKILPIIHASAFCQIATKIQDRLVECPLLSSVETASYDAQLVKWHEDLPSMLSKPDEPCPNFLRRTRLVMKWRFQNIRIILHRPILLTTALRHASWASLSADEKVSVGKCRFIACKTIEDISRDCMPDLLSGWNAVWFCFQACMVPLVSLFSDPSVPEEVEKWKASIKTALNFFEAVKDWSIAAKKSKDAVARLYAAYKTQASTLSQQTQTPVPQMPYPQQYQQPCHTQTHTHFPVPGTSNCPAMTNSQTTNYGQQQQPAFIQYNPATPGWVNTGNDPAILNNFWDDMMWDTNLPDMLETPFGIATDYEYVGAAQDPGPGGACWMHGN

SEQ ID NO: 91 - protein, 745 aa, Penicillium marneffei ATCC 18224
MFLTFEASQHNNNDNRTSLRNPKQERLNRRRRSTPRACTSCRQRKIRCDGEKPCEACRWYKKAEQCSYPGRERESHSEEISLPDYRGALKRLFPETAPENLVDLSRERLLALISKPTDGSPYIQHSQHQDSLTIATSTSVETHVSALAMERPGLESLHSIPAEQEQLDENRCASASEESEEHISDDVNALSLPARNLTSYLGVSSIQAALKVIAWLHPELNSHLSHVPKDQRQHHRRSSISAGLPPSDLQLLDAYFDNFQPFSPLLDEETCRSTFLSGRRKDNRWLALLNIILALGSITAAGVDNHNHRTYFERSMSFLNFKILGNPSLEVVQTLGLMGGWYCHYISQPNLGYALMGASLRMAVTLGLQREPPFDSHMSAGVSPARSGYQEFKRRVWWSLCCLETWGHETLGRPSMDFFRPSITVKLPHLLDNENYIKVLPLIENVQFIKIASKIQESLAALPTLTHTELLNLDSQLLQWWNNLPPVLKDYTPCPEALYAARTVMRWRFYNQRMLLYRPRLLNYAMRRIPLIAIKDEERVAVQRCREIAEVAIEDISTTTTAMKMNQMIAWNAVWLVFQATMVPLIYLSVAAVADKQRDDGDDVETCKAQVRRSISTLDRMRPYGHTAKRSSGMISRILEIILRTPDTGVRASVLETHNNAGNTEPQNYPPFLTNHQPIARERVLDWTATTAATTGATNNTSFENYSSQHVWEYLSWGENNDFWAELYTSLNPQEEANFFDARIQ

SEQ ID NO: 92 - protein, 651 aa, Metarhizium anisopliae ARSEF 23
MQTLASSANAPGGMPTFDKTSEQLKLQSKVLETLFPGSNLKDLLEKSQSELLELLSVNHVSPRSKVHQLPPHMPITPGPPPVLPQRREREEDDQFASGSPAQGSASVSENEEAAEERQWDESLDQPATVASDDINAIGLAADNHHARSYLGVTSMSAVFRTIFQLCPAAKEHTNKCARSLAAVPSPVYPTVPVTGRDPALSVLREQRFIDFYFEHIHPLTPLLDEQDFRSQYASGTRRDGSWMGLLNMVFALGSIASGSEGLHEQYYREARSFTGLDSLGSGNLESLQALCLLGGYYLHYRNSPNMAYGILGTAQRVAIALGLHREPRRAMETPDPGEMESCRRRVETRRRTWWSFFCLDTWACMTQGRPTCGRWESSTMDTYFPSCLYPDDQEATLLRANIEFCLIFERAQHRYAQFSRLSNQEILALDAELQTWYKSLPQETKQVDNAPQRFRFARELLKTRYYNARIILARSLILYMAHDLKRKPAELLPEQGHILDHCCSIAAEAIDSTARYWSPNRIHVWHSAWYLFQACTVPLLSIAINRNMEQRQQKQVSSPSSDRVVSWQTSLAKALDTFAEMRPWMRTSDRSPDIVSALYEALTAAGEVDGQTPSATDGSLDLFGWCDDQLTELDWRVFLGDEGLARGMYPV

SEQ ID NO: 93 - protein, 517 aa, Sclerotinia sclerotiorum 1980
MPSSIGSAKMFHTFQGLAPPRQTLSSEQTIQDTPKATTNGVTKRITTPHACAECKRRATSIKAALLVMLKVAPRLRSLLAPSNNKHIPASSNYPTPGPGNSVKELHAVSWSSDGQTLIDAYFNRVQIFVPMLDEPAFRADFLKGRRQDAPWLALLNMVFAMGSIVANKSDDHNHIDYYNQAKDHLGIDSFGSGHLETLQALSLMGGYYLHYINRPNMANAICGAALRMACAMGLHREIATQIQDALAQTPLLRSDDLANLDAQLVEWYENLPWILRSTEPCPESMYTARCVMKWRYQNLRIVLYRPVLLNLANRGNQGIASSKEEIAAIRTCRTIARETIEQISREWSPNQMLGWNGVWFMYQASMIPLVSIFWESWNTNLVRDWQSQIEVVLEAFDGMADWSLAARRSREVVSKMYEASKRPLTRHPSPGLSQISEDMNRMGGIDGRHYMDSEMLQQVEIMGEEQLMMLDNGGIWDLDGMLWGNLPDGLDMPYDGLPMQYDDSAMGQFGTPYIIHQ

SEQ ID NO: 94 - protein, 608 aa, Trichoderma reesei
HACLECQRRKIRCDGKQPCGRCQSSRSRRRCVYEQHRQRLVPSRKSLEELSRNLEECRSVLRRLFPNHQVSHLLSLSRQELCSLLDQPAQQRTVDLSPVPPSPKDDQQHPTELEQMPAQNSQWDEERRDRDPLPAEADDVNALSLAMDKQASSYLGASSVKVALTVMLQIQPQLQLLLASQPSADSSSDDNTRSKVPLIRAASRSAKKQFPIPWTYKGQALVDAYFKRVHVLTPLLDEASFRKHYSEGRRCDAPWLSLLNMVFATSSIMSTPSSNLSHIKYYNQAIEHIHLSAFGSSHIETIHALGLLGGYYLHYINRPNMANAIIGAVLRMATALGLHREPPPEEPQSDPAVVESRRRTWWTLFCLDTWGTTTLGRPSFGRWGPAINIQPPKLVTENVEYDSAQFGGIMPLLENIKFCKIATKIQDMLAVSPLLESEDRHHLDSLLVDWHNNLPWLLRSTEPCVESLHLSRSVMTWRYWNLRMLLYRPVLLTLASKGQLPISEQDVAAVKNCQEAARETVDSVSKGWMRQQMSGWNAVWFLYQAAMIPLVSILWQPDNPAVVDWRAQVESTLELFEAMKDWSLTARRSRDVVSRLLEASSKISNTRQ

SEQ ID NO: 95 - protein, 768 aa, Neurospora crassa OR74A
MDEDRPRKRVRVSIACHNCRNRKSRCDGQHPSCGRCKELDAPCVYDEPPAPHHRPRSSTTDTPPSDILSRLSALEDRINARGTEASRQHATQDDGDDIDAQEDTRESNGSSSNGPLDPPTMTGLPRSHQENVHVDGMGEVQLTDDGENCTYFGPSSNVALVRQLSLALTRAQSQTSRSRAMPTSATSLASSRYSSLQQPRSESGRQDPLNGGVKAGSRPGHHVPPEPEATNIIHEYFSTIGLFFPVIHQDSFMSTYNDLRKKGFMGARRVWLALLYMIIATVYRTNSPSTPSETSAETSERYFQWAKDLVMPQFLISSSLETVQLLCLMIEYLHGSSQSAQLWTLHSLAVKSALQIGLHSADASRHLTLLEREMRKRTWFLIFMNDNNLSAKFGRPMTIPPSLQKRLEPPLDINEHFPTMYASRAVIATSVDAFKCGVQLSHITCQLVSQLYDDNAGGSSLNHVNTFDTLRLAFDFSWKLSQWHQSVPPDLRPQNLTTETPPPVLESSSSSSSPSIEAQRLRAVLGLRYYGLCTLVERPVLLKFLGFQPEPGHGQGDVDTNVALLRESGVVSLRRCIRACRECIALAKAIVDRWQNQKVLLSGAWWLTAYHAFGASLTLYTVLLIAGTKPSFSNLLSDSELTTVRSALSDAVDLLSRFGENSLVISRCHDCLVNFLRAYDLVVVEQQRQQKQQQESQSTTVAATVQTSRNSDHTSSSQSLPPQGQGQGVHVNVIGDGNGVSLTSSSSSSSSSGGYCHEDQLPSSPAVI

SEQ ID NO: 96 - protein, 834 aa, Neurospora tetrasperma FGSC 2508
MAPSISIPTQGGMFHTFQGVTPRKPAVDSRDSVKSNGSGAAKRITTPHACAECKRRKIRCDGQQPCGQCLSSRAPKRCFYDKHRQRVIPSRKTLEALSQSLEECRSILKRLYPHQEVHALLPLSRQELLNLLDRPVPDSTANGLPSPPLNTTPMADSETPTKSENILEQIPTRDTEWDEERRERDHIPVEADDINALSLSVDRQASFLGASSIKAALMVMLKVQPGLRSSLAAPLNSIEISHNFPAIRQKSSTQKDPQRIPWSWKGQTLIDAYFKRVHVFIPMLDETTFRADYLEGQRFDAPWLALLNMVFAMGSIVAMKSDDYNHVNYYNRAMEHLPMDSFGSSHIETVQALALIGGYYLHYINRPNMANAVLGAAIRMASALGLHRESLAQGGSDMVAAETRRRTWWALFCLDTWATTTMGRPSFGRWGPAINIRPPEFGVNAGRDSSQHAGILPMIENVKFCKIATQIQDMLAISPLLRTEDRCNLDGQLVVWYENLPWLLRTTDPCAEPLYMARCIMKWRYQNLRMLLHRPVLLSMASSGLNPHTQACDSDLAAIETCRELAAATIEDIGREWTRNQMSGWNAVWFLYQAAMVPLVSVFWQWGNPRVPEWLKQIEAVLELLEAMEEWSLAARRSREVVLRMYEASRVIQAQGAAAHQLQQRGSQSPHSLNSTTASLGSMHINNDLLMGSPGSAELYMTPIDLEPVEGLGMTGVLDHGGMWDLDGMLWGPSPSPSVHHGHHSTHPDDAVPTVAEYAAAFPTADVVDGFLQHHSAMEFGNMMGHHHHAGAHAGQGQFGVGLVARGYAQLARRRLEGPKYHHIRWLDAATGLT

SEQ ID NO: 97 - protein, 766 aa, Phaeosphaeria nodorum
MFHTFQSSTALRSPGDDTDVSGKPSRPAGSRRISTSNACVECRRRKIRCDGSQPCGQCQWYQHPEACGYSKPAQRVVPSRKLVDKLSTNIEQYKAVLNKLYGSKDLATLANLPREELLEMALSSSSTPGQVTSPNSLEGRATSEIHTGSDGADSLEALEQAPPEDPFWDEARKHQLRVQGISDDVNGLSMSVDRLSSYVGISSVTAALKVIVRCAPHARALITQQTNETTLPSRAGSPPPELTDSSPLALPSSTHGQELLESYFDQVHPMMPLIDERKFWSTYLYGNRKDSQWLCLLNIVFALGSLVSSSTDNEAHYVYFNRCRQHLSLESFGSGNLEVLQALVIMSGLYMHYLNRPNEAHSLMGGALRMATTLGLHREYSERSEAGSHMMLPGFEESLSPEMRRRIWWSIFCLDAWASTTTGRPSLGRMGPSITVLKPGTAADAVSTVPSPNSPQYMEQLKMLPLIHSSVFCSIATRIQDRLVEQPLLSPTETSTYDAQLLKWYDELPSILVKQEPCPDFLRRLRLIMKWRFQNIRVILHRPYLLTAALRGCAWINMSAEEKVAIGKCRVLAMKTIEDMSQECMPDLLSGWNSVWFCFQACMVSLVSLFSDASMPEEVHKWQASIETALQFFDSIRDYSIAAKRSKDAVSKLYQAYKAYAVPATQIPPQISMSQHQYQAQTPYSMAPNPMQLGAHTNLGARNPYQFNPGTPSWSSDPNFLNNFWDDMMWDTNLPDLLEHPFGLSNEFEYGGAAQDSGNNGWLQGN

SEQ ID NO: 98 - DNA, 1914 bp, Aspergillus terreus
atgtccccttcgccagacagggaccgagatactgtccttgatccagccattgtggctgcttctatcgacttcccggatggcaagaaaaaacgctccaattcagaggccaccgagtatccccgacggcgtgcgactatagcgtgccagatatgtcgcttgcgaaagacacggtgcaatggtgcacgtccaagatgccagctctgcacagacttggatgccgattgcgtctaccgagagccgggaatcaagctcgacgcgggagacaagttgatcatcgagaggctgaacagaatcgaaggtttactccaatccagcctagtaggacaacaccctccctttcctcagtcgtctacctctcctgcaaccagtaacgacaccaaccttggcagcgatgacatggtaaacaaatcaagcctgaccagcttgtcaggcagaacttctgtcgctggcatggcgtcatgggctaatcctcctgcaagcatctcaacaatgcccaaggtccataccaccccggcattacaccttctccaatggcctttgatccgagatctagtagcgggcccctacgaccctcacaccctcctgcaacttgaaatggcccgcgagcctctcaggatgaccactgttgctggacttgacttatccaatgcaaatacctatgtgcagtccttttttgaacgcgttaatgtgtggtatgcctgcgtgaatccgtacacgtggtcccaatatcacaagcgagcaatggcccaagggttccaagaaggagcagagagctgcgtggtgctcctggttctagcgctaggctgtgcaagccactatggaaccatctcgtccattcctcccgatagggaagctcctggcctgccatatttcaccgcagcgtggaatcttttgccctctgtgatgatgcgcaattccgtactcgcagcccagtgcatcatcttgtcctctgcctacttattctacctagtgaggccgttggaggcctggacgctactatccaacgccagcatgaagctccagttacttttcggcaacacttcgcgtgttcctgcacagtggaaagagctcagcgtgagagtatactggaatgctcttctctacgaaagtgacctcctagcagaactagaccttcctcactcgggtattgtgcactttgaggagtcggtcgacttaccaggaggatttgaagaagacgacgaggaggaggaagacgaggacccggttgaaaatccccataatggcatgatccacagtgattcagtgggcaatgacgagctttggtactttctggctgagatcgcgcttcgaagattgcttaaccgtgtcagccacatgatataccagaaggacaataccttaacactagcctccctcgggcctatcgtctcggaattggatttccagctctcacaatggtatgacagcctcccgcggcccgttcagttccctctcgcccatacacccttctccaatcccgtccagaccgttctacgactgcgatactatgcttgtcgaacgatcatctaccgaccctatatcctagctgtctttgaaaatgagcagacttccgccgacccgcttgtgaaagagtgctgccgacgatgcctggaagccacactacgccagttggaagatattaccagtcaccgtgaaggacatctcccctacctttggcaaggagccttgtcgatggtgtcacagacattgctcatcatgggggcaacaatgtctcccgctctggcggcattattgcccccgcccatccgagtggatggaattatcgccggcgtcatggcagaggtggatagatatgcccatctcgcgcccagcttgagactttcagccgaaatcattcgagacgcggaacgacggaggcaggtttggatccggtcgtcgggtaagagactttga

SEQ ID NO: 99 - DNA, 2115 bp, Chaetomium globosum
atgtcgccgtcttccaacggcgactcaccgcactcggtcaccgccaccatgacgaccgctgccagcgccaccgtggtaagacagcagtatccgctgccgaatcgggatttcaccgtcgacatcccgtcgccccagcttgccgccggttccaatggcgccggcctgctcaagtcgccaaactcgctcaaggcggcgcgggctgcttctaacttcagtcgggagggcatccttggctcggcccaaaaagcgcggaatttatcacagtcgtcagacaacaggccggacggagtcccgaatggcatcccaaagtccacgagcgaagagagcatcaacccgctgaagaggagaaacacagatgcagcagtagattatccgaggaggagagcgaccattgcctgcgaagtgtgccgctcgaggaagtcgcgatgtgacggcacgaaaccaaagtgcaagctctgcacggagctcggcgctgagtgtatctaccgagaacccggcatcaagctggacgccggcgacaagctcatcctagagcgcctaaacaggatcgagaacctgctccagatgaatatggtgggccacggcaatggcataagcttatctcacgactcgccaaatatgagcaacggcactgctttgagcggggacaatctcatgatgcggaacgcgaacaacgagttcgtctcgatcatccctagcggcggcctgggcacctggtccgcgacggccaccaacatatcaactatgccaaaggtgcacacaaacgcagccctgcacctgctacaatggccgctcatcagagacttggtctcgcggccatacgacccccaaatcctacttcagctcgaaatggcccgcgaaccgctgcactcgctcgcaaagacgccctgcgtggatttgtcaaataccaatgcttacatcgaggcctactttgatcgcgtcaacatctggtacgcctgcgttaacccatatacatggcggagccactaccggatcgcgctatcgaacggtttccgagaagggccagagagttgcatcgtgctcctcgtcttgtcactcggccaggcgagtctgcgcgggagcatatcgaggatcgttccgcacgaggacccccccggcttgcagtatttcacggctgcctggtcattgctccccggtatgatgacctccaacagtgttcttgccgcgcaatgtcacttgctcgccgccgcctacctcttctacctagtgaggccactcgaggcatggaatctgctctgcaccacgagcacgaaactgcagctcctgctcatgacgccaaatcgagtccccgccgaccagagagagctcatcgagagaatctactggaattcgctccttttcgagagcgatctattggccgagctagatctgccccactcgggcgtcgtcgcgttcgaggagaacgtcggcttgccttgcggcttcgagggagacgagcaggaggcggtcgggcgggacgagctgtggtacttcctggccgagatcgcgctgcgtcggctcttgaaccgagtcagccaactcatttattccaaggattcgatggcgtcgacgacaagtctcgaacccgtcgtcgctgaactcgacttccaactgacgcagtggtacgagagcctgcccgtgccactgcaattcccctttacgcgcaccatgctcgcggatccggtacagacggtgttgaggctacgattctttgcttgccggaccatcatctaccggccctacatcctcgcggttctggacaacgagcaggccatattagaccccgcggtgcgggacagttgcaccaagtgcctagaagcctccgtccggcaattggagcacattgccgcgcatcacgccggacacatgccgtacctttggcaaggtgcgctctccatcgtgtcgcaaaccttactcgtcatgggcgccacaatgtcaccgtcgctgtcatccatcctttggagcctcgttccccaccgcgaggctatcgaccagatcatcaacgatgtggtcatggagatcgaacgcttcgccgtcctctctcccagcctcagcctgtcggccgagataatcaaggaggctgaagtccggcgccggaccttcctgagcggttga

SEQ ID NO: 100 - DNA, 1488 bp, Neosartorya fischeri
atgtctgggagaacctccgttgccggacttgggtcctgggtgaacccaccaacgagcatctcgacgatgcccaaggtgcacactactcccgcgctacaccttctacaatggccccttattcgggacctggtcgctcgtccctacgatccgcagacgttactgcagcttgaaatggcccgcgagccgcttagatttccttccgctgcagggttcgacttgtccaatacaacaacgtatgtacagtcttttttcgagcgggtcaatgtctggtacgcctgtgtgaacccatacacttggacacgctattacagtaaagccgtctctctgggattccgagagggacccgagagctgccttgtcctcttggtcttggctctaggcagcgccagtcactacggaagcatctcgttcattccttcagatatggaccccccaggactaccttactttgcaacagcgtggaatcttctgccatcagtaatgatgcgcaactctgttttggctgctcagtgcatcatccttgcgtctgcctacttattctacctagtcagacctctggaggcttggaccctcctctccaatgctagtatgaaattacaattactcttcggggaccccgcccgtgtaccccttcagtggagagaactgagtgtgagagtgtactggaatgctctcttatatgagagcgacttgctggcagagttggatctgcctcactcgggcattgtgcacttcgaagaagttgtcgaccttcccggtggtttcgaggaggaggaggacgaagaagatgatgaagctgacaatgaagatcgtcaaaccagcttagtagagggctcggtaggccgcgaggaactatggtatttccttgctgagatcgctcttcggcgactcttgaatcgcgtcagccatatgatataccagaaagataactcgctgactcttggatcacttgggcccattgtctcggagctggatttccaactttcccagtggtatgagagtctccctcaaccagtccagttccccctcagccacacaccgatttccaaccctgtccagacagtcctccgattgcgatactacgcgtgccggactatcatataccggccatacatcttagctgtctttgagaatgagcacgctgcgactgatcaggtagtaagggaatgctgccggcggtgcttggaggccacgctgcgccagctggagaatattaccagtcaccgcgaaggccatctgccctatctctggcagggcgcgctctctatggtatcgcagacattgttgatcatgggggccacgatgtcccccggactctccactttattgcctccgggattccgagtggatgcgataatatccagtgtgatggccgaggttgagagatacgcacaccttgcgccgagcctcaaattatctgcagagatcattcgcgacgcagagaaacgacggcaaatttgtctcaggtcgaccagtcgacgagtatag

SEQ ID NO: 101 - DNA, 1845 bp, Aspergillus clavatus
atgacgccttccccagagagggacttggtcctcgactcagcctccacagctgccattggagaatttcaagtcagcaagaaaaagcgatctagctcggagctggcagaatatccccgaaggcgtgctactatcgcatgccaaatatgccgcctacgaaagacccgagagccaggaatcaaacttgatgctggcgacaagttgatcattgagaggttgaacagaattgaagggttgctccaatccaacctcttgggacaagcctctcacttcccgttatcctccacatcccctgccaccagcaacgatacgaatgtgggtagtgatgatgcagctgccaaagcatctactatcgcggctatgtctgggagaacttcgattgctggactagcgtcgtgggcgaacccccccacgagcatttcaacgatgcccaaggtacacactactcctgcgctgcacctcttacaatggcctctcattcgggaccttattgccgggccttacgatgctcaggcattgctgcagctcgaaatggctcgtgaaccgctgcgcattcccacttctgtgggattcgacttaacaaactcggccacttatgtgcaggcattcttcgaaaaagtaaatgtctggtatgcctgtgtcaatccctacacgtggacaacttatcataataaggctgtctcccggagtttccaagaggggcccgagagttgcgttgttctgcttgttctggctctaggaagtgccagccactatggaagcatcgcattcattcccccggacatggagccgccggggctaccttatttcgcagcagcatggaatcttctcccgtctgtcatgatgcgcaattctgtgatcgctgctcagtgcgtcgtcctcgcctccgcctatctattttatctggtcagaccactggaggcctggacgcttctatcgaatgcgagtatgaaactacagttactttttggcgaccccgcccgtgttccccttcaatggagagaattgagtgtgagagtgtactggaacgctcttttgtacgagagcgacctgctcgcggaattggacctacctcattctggaattatccactttgaagaactcgttgacctcccgggaggatttgaggaggaagtcgaagaagatgaagatgatatcgaaaacagcgatcgcgaaagcgcccctgtgaacggttccgcaggtcgcgaggaactatggtactttttggcggagattgcgctgaggcgactcttgaacagagtcagtcatctgttatatcagaaggacagttcactgacgctcgggtcgttggggcctattgtgtcggagctggactttcagctttcacagtggtatgacaatctgcctcaaccagttcagtttcccctcaaccatgcaccgatttccaatccggtacaaacggtccttcggctgcgatattacgcatgccggacgattatttaccgaccgtatatacaagcggtctttgagaatgagcaagccgcggcagaccaggtggtaagagaacgctgtcggcggtgtttggaagctacactgcggcagttggagaacattacgagccaccgtgagggacatctcccctatctttggcaaggcgctctctccatggtatcacagaccttactaatcatgggggcaaccatgtcacctggactctccaccttactgccaccgggattcagagtggatgcgatcatctccagcgtaatcactgaggtaggaaggtatgcacatctcgccccaagtctcaagctgtccgcagagattatccgcgacgcggagaaacgacggaagatctgtctcaggtccacgactggacgcgtctag

SEQ ID NO: 102 - DNA, 1812 bp, Aspergillus niger
atgtcttgtcaggaacttgacagtgatactattctcgattcaacctcagcaaaaaagcgcaacaattctgaagcaaccgagtatccccgaaggcgcgcaactatagcgctctgcgtagacctggatgcagattgtgtctatcgtgagccgggcatcaaactagatgccggtgacaaactgattatcgaaaagctgaacagaatagaagtcttacttcagtcgaagtttgcagaccccatcggccagtctcccctgtcatcgaattcttccacggctgccaaccttgtccaaattagtagcgatgatgctgtcagtctcgccaacatacctaccaggacaatcgcggtgggtcttggatcatgggcaaatccaccgacaagcatctcaactatgcccagagtacatacgacaccggctttgcaccttctacaatggcctctcattcgagaactggtcgctgttccttatgatcctcatacacttctacagctagaaatggctcgtgagccacttcggctcgaacctcctgtgagcttagatttatcaaacgcacttactcacgctcgactttttttcgagcgcgtaaatgtttggtacgcttgtgtcaacccattgacgtggcctcgctattacaagatggctctttctcgggacttcgagagagggcctgaaagctgcgttgtactcttggttttggcactgggcagtgccagtcaatatggaagtatatcttgcctttccgcagatgaggaacttccaggactatcatatttctccgcagcttggacccttttgccggctgttatgacgcgcaattcggtgcttgcagcgcaatgtgtcatcttggcatctgcatatttattttacatggtcaggccccttgaggcctggacgctactatcaaatgccagcatgaaattacaattactcttaggtaacccctctcgtgttccggggcaatggaaggagctgagtacaagagtgtactggaacaccttactatttgaaagtgatttgcttgccgaattagacctaccacactcggggattgtgcattttgaagagctcgtcgatctccctgggggctttgaaccggaagatgaagaagatgaagaagacgaaggaagcatacgaattgaagagaaactagtagatgcgatgataggtcaggatgagctctggtatttcttggctgaaattgccctaagaaggctgctcaacagagtcagtcatatgatctaccaaaaagacagcatcttgacactcgcatctctcggtcctatcgcctcagagctagatttccagctgtctcaatggtatgaaagccttcctcagcctgtccggtttcctctatctgggggcccaactttaagccccattcaaacagttttaaggcttcgctactttgcctgccgtacaataatatatcggccttacatcctggcggtcttccagaatgagtatgcatgcagtgacccgacagtaaaagactgctgcctgcggtgcttggacgcgacattgaatcaactcgagcatatagacagacatcgtgaaggtcacctgccgtacctctggcaaggtgccctttccatggtctctcaggcgttgttaatcatgggggcaaccatgtcaccgactctctcatcgctgttgcctccagcgactcagctagacggtatcatatctggcgtcataacggaggttggcagatatgcgcggcttgcaccaagtctaaagttatctgccgagatcattcgtgatgcggaaaagagacgccaggtgtccctcgcgtcagcggccagacgaggttga

SEQ ID NO: 103 - DNA, 1608 bp, Botryotinia fuckeliana
atgtcaatctcatctcaaggaaattctcccaactctacctccggaagcattagacacttctcaatgtctcgggacaaatttgatatcgacatttcctcgccccaactttctatcgtaacaaatagcgatttgacatctccaacctctctaaaatcaccaaacggccgtcgtatcgcgactttttcccgagagggtatcttgggatccgcacagaaagctagaaatttatcacaatcctccgcagatagagaatctatcacaaatgcactacagagcagacaaaatcataatcataatcataatcaaaaccaaaatagaaatgggaatggaaatacaaatggaaatggtaatcagaatgggaacagtgatgatggaatcaatccgttaaaaagaaggagtactgatgctggcattgactaccctagacgaagagctactatagcttgcgagatatgtcgatctcgaaaatcacgatgtgacgccaccaagcccaaatgcaaactaggcacagaattgggggccgaatgtatttatcgtgaaccaggaatcaaactcgatgccggagataaactgatattggagcaccttactcggatcgaaggattacttcaatcaaccttaatcggccaaacatccaatcttgctctctcaaccggatcaccatctatcaatggaggaaccacagccagtggcgaggacctattaatggcagctagcggaggctttgcctctatgatacctgccacaggtcttggcacatgggctatccccactaacatctccacgatgccaaaaattcacacaaacgctgcactacacttactccaatggcctttaattcgcgatttagtatcgcgaccttacgatcctcaaatccttcttcagctcgaaatggccagagagccacttgctttgtccaaagcgccgtgcttagacttatcaaacacctctgcatatatcgaagcattcttcgccaaagtgaatgtctgtacaagtacaaagcttcaacttcttttaagtgcgcccggaaggataccagcaagccaaagagaattatgcgagcgagtgtattggaattcattgttgtttgaaagtgatctgttggccgagttagatttaccacattccgggatagtccaatatgaagaaatagtagggctgccagggggttttgagcaagaagatgaggatggagtaggccgcgatgagctttggtactttttggccgagattgctctacgccggctattgaaccgtgtcagtcaactcatttactcgaaggattcgatggcgtcgacatcaagcttagagcctgttgtggccgagcttgattttcaactgtcacaatgccatgcaggtcacatgccatacctttggcaaggtgcgctcagtattgtctcgcaaacacttctggtaatgggcgccactatgtccccctccctttccgcgatcatcaactcactcgtcatccacgatacaatcgacggtataatcaatgacgtcgtcatggaaatcgaaagatatgcccatttagcacccagtctaagtctctctgccgagataatcagagaagccgaaatgcggagacgcagctaccttggtggctga

SEQ ID NO: 104 - DNA, 2067 bp, Sclerotinia sclerotiorum
atgccttacgtcggcgcaatgtccgtctcatcccaagattcacccaactctaccaccggaagtggtagacatttctcaatgtctcgagacaaattcgacatcaatattccctcacctcaaatttctctcgtatcaaatggtgatttaacatctccaacatcattaaagtcaccgggtactcgtcgcatcgccactttttcccgggaaggtattttgggatccgctcagaaagccaggaatttgtcacaatcttccgcagacagagaatcaatcataaatgggctacaaaacagacaaaaccaaaatcagaaccataatcagaatggaaatcataatcagaatgggcatagcgatgacgggatcaatccattgaagagaagaagcactgatgctggaattgactaccccagacggagagccaccatcgcctgcgagatttgtcgatctcggaaatcacgatgtgacggaaccaagcccaagtgcaaactttgcacagaattaggtgccgaatgtatttatcgtgagccaggtatcaaacttgatgctggggataaactcatattagagcatcttactcgaatcgaaggattacttcaatcgacattaatcgggcaaacatccaatcttgctctttccaccggctcgccgtctatcaatggaggaaccacgaccagtggtgatgatttgatgattgcagccaacggaggctttgtctctctacttcctgccacaggtcttggcacttggaccaatcccacaaatatttccacgatgccaaaaattcacacaaatgctgcattacacctacttcaatggccgttgatccgcgatttagtatcacgaccttacgatcctcaaatccttcttcagctcgaaatggctagagagccgcttgttctgtcaaaaacgccttgtttagatctctccaatacctccgcatatatcgaagcatttttcgcaaaggtaaatgtatggtatgcatgtgttaacccatacaactggaataatcactaccgagttgctttatcaaatggattccgcgatggtccggaaagctgcattgttcttttagtgctggcgctgggtcaagctagttgcagtggaagcatatctagagcggttagttctgaggatcctcctgggcttccatattttgcagccgcttgggcactccttccaagtttgatgacgaggagctcggttttatctgctcagtgtacagttcttgcttctgcgtatttgttttatctcgtgagaccattggaagcgtggacactattgagtagtacgagcacgaagcttcaacttcttttgagtgcgcctggaaggataccaccgaatcaaagggagctatgcgaacgagtgtattggaattcattgttgttcgagagcgaccttttggctgaactagatttaccgcactccggtatcgtccattatgaagaagtggttggactacccggaggctttgagcaggaagatgaggatggagtgggtcgagatgagctctggtactttttggccgaaatcgcacttcgccgactactgaatcgcgtcagccaactaatctactcgaaagattcgatgtcatcgacatctagtttggagcctgtcgtggcggaattggatttccaattgtcacaatggtacgaaagtctacctattcctttacaattcccatatactcgaacacctctagcggatcctgtccagactgtgttgagactgcgatattttgcttgtcgaacgatcatcttcagaccatatattcttgctgtgttggataatgagcaggcagctatggatcctcatgcaggtcacatgccctatctctggcaaggagctctcagcatcgtttctcaaacccttctcgtgatgggcgccaccatgtccccctcactatccgccataatcaactccctcgtcatccacgacacaatcgatggcatcataaacgacgtagtcatggaaatcgaaagatacgcccatctagctcccagtttaagtctttctgccgaaataatcagggaagccgagatgcgaagacgcagctaccttggcggctga

SEQ ID NO: 105 - DNA, 1797 bp, Phaeosphaeria nodorum
atgtctcaatcctcgggcacggatcgtgagatgtcgagtgatcttaccccacctgcacaatcgaacggcacagcaccaacaagcaacggtgccaatggcactcactcagaaccacgcccgtcgacgaaaaagaggccaagcaccgacacgatagactatccgcggcgacgcgcgaccatagcttgcaggctttgcacagagctgaacgcagaatgcatctaccgtgagccaggcatcaaactggatgcaggcgacaagttgattctggagcatcttaaccgcatcgagggcctcttgcaaacaagcatcacgagtggattttccctgtcctcgcattcgccggctgtaagcaacaccacgagcgaggatttcctggcgcgaagctccggcactattccccacttgggcatggtccagcccatcaacggcatcggcacgtggactaaccatccctcgaacatctccacgatgccgaagacgcacaacaccgcggccttgaatctgctcgcctcgccgatgattcgggaattggtgtctcgtcaatacgatgcgaagatccttctccagctagaaatgacgcgggaacctgttagttttagcagctcgcgaggtctcgatctgtcgaacacggggacctatgtccaagcgtactttgaaagagtgaacgttttctatgcatgcgttaatccgtatacatggagcaatcattaccaaaccgcgctggcgcatggatttcgtgacgggcccgaaagctgcattgttctgctggtgttggcccttggacatgctggtagtaccggaagcataacacagcaaaaccccgagaaagagcctccaggcctagcatacttcgctgctgcatggtcgcttctgcctactgtgatgacgaggaacaatatggttgcagcgcagtgtcaaatcttggccgcggcatacttggtctatctagtgcgaccagtagaagcatggaacgtgttatcaggcgccagcatgaaattacaattgctgctgagtgcacctggaagggtatctccagcggaagaggagctgggcaaacgtgtctactggaatgctgtcatgatcgagagtgacctattggccgagctcgatcttccacactcgggtattgcacaattcgaagaaggcttctcattaccaaccggttttgaagacctgggaatggaggtagtgggccgtgacgagctgtggtattttcttgcagagattgcactacgaagattgctcaaccgagtcagctctatgctctacattcggaccacgccgtattcaaagggaccagctgccacatcggtagcacaactagacccactggtcgttgagcttgactatcagctgaaccagtggtatgccggactgccacaggcaatgcagttccccctagacagggtcccgttacaaaatcctgtgcagactgtcttaagactacggtactttgcctgccgcacgattatattccgcccatacgtactccttgtcctacaagacgagaccctggccctcgactccagtgtgcaagacaactgccacaaatgcttggaggcatgccgcatcatgcaggacatctcccttacctgttccaaggtgctctgtccatcgctgtcgcaactgcttccaccaccatctacaatggacgacatcatcaacaacgtcgttctcgagatggaacgatacgcccacctcgcaccaagcctgcgtctttcggccgagataattcgagaggccgagggaaagcgccagatgtggctacgcacagctggactgaagtttgaaccatga

SEQ ID NO: 106 - DNA, 2055 bp, Aspergillus oryzae
atgtctccttctccccaaagagacagagatactcacgttgaagcagtcgccgctgtgactgcttctgacgacttccagtcgagtaagaaaaagcgatccaattctgatgtggtcgaatatccccgaaggcgcgccacaatagctctctgtactgatctagacaccgaatgcgtctatagagagcctggcatcaaactcgatgccggtgataaactgatcattgaaaggcttaatcgtatcgagggactcttgcaatcaagtctagcaagccaggcagcacattgttcattaccctctacgtcaccggcaaccagtaatgataccaacatcggcggtgaagatacaccggttaagacatccagcgtggctgtcatgtctgggaaaacgtcagttgttggactcgcctcttgggctaacccacccacgagtatctcaacgatgccaaaggtacataccactcctgcgttacatctgctacagtggcctttgattcgggggttggtggccggcccctatgaccctcatacactattgcaactggaaatggctcgtgagccccttaggatgaaagcccctaaggagttggacttaacaaatgcaacgatctatatcaggaatttttttcgacgtgtcaatgtttggtacgcctgcgttaatccatatacatggtctcgatattacaaaaccgccgtgtcactcagctttcgtgaaggatctgagagctgcctggtcctcttggtcttggctcttgggtgtgctagtcactatggcagcatttcctctgtctcgccagacaaggaggccccaggcctaccctactttgcggcagcttgggaccttctccctatagttatgatgcgcaactctgtgcctgctgcacagtgtatcatactggcatcagcctatttattctacctagtcagacctctagaggcctggacccttctgtcaaatgccagcttaaaattacagctccttttcggcaatccatctcgtgttcctcttcagtggaaggaactaagtgtgcgaatatactggaacgctctgctctacgaaagcgacttgctagcggaactagatctaccacattcgggaatcgtccactttgaagagctagttgatctacctggggggtttgaggaggaggatgacgaagagtaccaagaggctgaggatgcacatggtgaaattgcatctgaaactgagcctgttggtcacgatgaattatggtacttcctagcagaaattgcattgaggagattgcttaaccgtgtcagtcacatggtttatcaaaaggatagcccattaactcttggaacacttggacctattgtttccgagctggactatcaactctctcagtggtatgagagtctgccccaacctgttcagttccctctctctcgtacacctgtgtcaaactctgtccagactgccctacgacttcgatattttgcatgcaggacaattatctaccgaccttatatgttggctgtttttgaaaatgagcagacatctttagacccagtggtaaaggagtgctgccggcggtgcatagaagccacaatacaccaactggagaatataacaagccaccgcgaaggtcatctaccatatctttggcagggagccttgtccatggtgtcacaaacgctactgatcatgggggctactatgtctccaacgctttctgccttgctgccccctgcagaccaagtagatcggatgatatcagaagtagtggcagaggtcgagagatacgcccaccttgccccgagtttaaagctatcagcagaaatcattcgggatgcagaaaaaagacgtcaaatctgtttgaggtctacagggcgttgcacttaatttacattcatcgtctgctttttcgcctcttcccccaggcccggtgacagtatcgtcccgtgatgtcaactcgaattcacgtgcaggtaaatatacattatatcaaacaagtaagagaataacaacgaaacgaacaacgaaattgttagcgcagatatcgagagaatagcatatatacagctcaatcatggatat

SEQ ID NO: 107 - DNA, 2121 bp, Podospora anserina
atgtcaccatcgtccaacggtgactctccacattcttccacggccactatgactgcggctgccagtgctactgttgtaggaaggtttccattgccgaacagggacttcaccatcgaggtgccctcgccccagcttctggcccaggtccagattaacggcggtggcgtaaactctctcaagtcaccaacatctctcaagtcggctcggactcctagcttcagcagggaaggcatactcggttcggcgcagaaggcgcgcaatctttcacagtcatcagacaacaggccagaatcgaatgggatgcagaaggcaccgagcgatgagggtatcaaccctcttaaaaggcggaataccgatgcgggcgtcgactatccaaggcggagggcaaccatcgcttgcgaggtttgccgttcgaggaagtcacgatgcgatggcacgaagccaaagtgcaagctatgtaccgagttgggtgccgagtgcatttatcgcgagcccggcatcaagctggatgccggcgacaagcttatcctggagcgcttgaaccgcatcgagaacctgctccagatgaacatggtgggccaccccaatggcatgggcatgtctcatgattcgccaaatatgagcaatgggacagctctcagcggtgacaacttgatgggaatcgggtccaatgccgccaactttgtgtccgtcattcccagcggtggacttgggacatggtccgccacagccactaacaatatttcgaccatgccaaaggtgcacacgaatgcggctctgcatctgctgcagtggcccatgatccgcgatttggtatcacgaccgtacgaccctcaaattctcctgcagcttgagatggcccgtgagccgctgcactctctcgccaagactccctgcgtcgacctttccaatacgaatgcctacatcgaagcctactttgacagagtcaacatctggtacgcctgcgtcaacccatacacgtggaggagccactacaggatagcgctatcaaacggtttcagagaaggaccagagagttgcattgtgctgttggtgctggccctgggccaggctagctcgagaggcagcatctcgaggattgtaccccacgaggaccctcccggacttcagtatttcaccgcagcttggtctctgctgccaggcatgatgacgtccaacagtgtgctcgcagcacagtgtcacttgctggctgctgcttatctgttttaccttgttcgaccgctggaggcatggaacttgctttgcacgacaagtacgaaactgcagcttttgctcatggcgccgagtagagtgcccgctgatcagagggagctgatcgaaagaatttactggaactcacttctcttcgaaagcgatttattggccgaattggacctcccccattctggtgtggttgcatttgaggagaatgttggtcttccctgcgggttcgagggcgatgagcaggaagcagttggacgcgacgagttgtggtatttcctggccgagattgcactgaggaggctgctcaaccgcgtcagtcagctcatctactcgaaggattccatggcatcaacaacaagcttggagccggtcgtggcagagcttgacttccagctgacacagtggtatgagagcttgccgctaccgctgcagtttcccttcacacggacgatgcttcccgatccggtgcagacggtgctgagattacgcttcttcgcctgccgaaccatcatctatcggccttatattctggcggtccttgacaacgagcaagcggtgttggacccctcggtgcgggaggcttgcacaaagtgcctagaagcgtcaatccggcaactggagcacattactgcgcatcacgccggacatatgccgtacctttggcagggtgctctgtccatagtatcacagacacttttggtcatgggcgccaccatgtcgccgtcactgtcgagcatcctctggagcctggttccccaccgcgataccattgatcaaatcatcaacgacgtcgtcatggagatcgaacgctacgctgtcctgtcgccaagtctgagcctctcggctgaaatcatcaaggaagccgaagtcagacgtcggacctacctcagcgggtga

SEQ ID NO: 108 - DNA, 2028 bp, Pyrenophora tritici-repentis
atggcagctatcactccttctccagacgttagtcccgtatcgtcagcaacgaccaatggaggtttccccagggatgccttctccctcaatctctccactttgcccgacgccaacagctttatcctcaagtctgccctgacctctccccatcttctcgactccccaaatgatctgttttcaggaggcggccgtttgagtaattccttcaagaagcggccccgcaatatgtctcaatcatccggtaccgatcgggaaatgtcaaatgagaacactccacccgcctcaaacggtattgcgcccacaagcaatgggaacgacggctccaacccagagccccgaccagctacaaagaagcgccccaaactgaatgccgaatgcatataccgtgagccaggtatcaagcttgacgctggcgacaagctgatcctggaacacctgaaccgcattgaaggtcttctacagtctggcttcaccagtaactattcattgtcttcgcattccccagctgcaagcaactcaacgagcgaagattttctcgctcgcagtgccggccatataccccatctcggtatggttcagccgatcaacggcataggaacatggaccaaccacccctcaaatatctccaccatgccaaaaacacacaacacggcagccttgaatctgctatcctcacccatgatccgggaactggtgtctcgtcaatatgatgccaagatactccttcagctagagatgacccgtgaatcagtaagcctcggtacaactcgcggtctagacttgtccaacactggcgtgtacgttcaagcatactttgagagagtaaatgtcttctacgcagtcgtcaacccatatacatggagtgatcactaccagactgcactcagccacggatttcgagatgggcctgaaagttgcattgttctcctagtacttgcgcttggtcatgctgcaagcaccgggagtataacacaacagaacccggacaaggatccccccggcttggcatacttcgccgcagcttggagtctgctaccaaccgtcatgacaaggaataacatggtcgccgcgcagtgtcagattcttgctgcagcatacctggtgtaccttgtacgtcctgttgaagcctggaatgtgttgtcgggtgcgagtatgaagctacaacttcttctgagcgcacctggccgagtgtcgccagctgaagaagaacttggcagaagagtgtattggaatgcggtcatgatcgagagcgatcttctagcggagctagatcttcctcattcaggcattgcgcagtttgaagagggcttttctttgccgaccggctttgaagatttagggaccgaagcagttggtcgggacgagttatggtacttccttgccgagatcgcccttcgaaggttgctcaatcgggtgagttcgatgctctacatccggaccacaccgtattcgaaaggcccggctgccacctccattgctcaactagacccgctcgtcgtggaactagatttccaattgaatcagtggtatgccggactaccaccagccatgcagttcccgcttgatagggtaccgttgcagaaccccgtgcaaacagttctcagactacgctactttgcatgccgcacaatcatctttcgaccatacgtactgctcgtgctgcaggatgaaagcctggcaatggattccggtgtgcaggacaattgccacaagtgtctggaagcatgtgttcgccaactagagtacattactgcgcaccacgccggacatatcccctatctgttccagggtgcgctctctatcatctcccagaccctgctcatcatgggtgcaaccatgactccttcactctcccagctacttcctccaccagcaacaatggacgacatcataaacaatgtggtccttgaaatggagcgctacgcacatctcgcgcctagccttcgtctctccgctgagatcattcgtgaggccgaaggaaagcgacaaatgtggttacggacagcaggcctcaaattcgaagtatga

SEQ ID NO: 109 - DNA, 2473 bp, Penicillium marneffeif
ccgcaacaagagaggagaagaaaagagatgcgggcggccgttgcgcgcccagcaatgcgacaatgagcaagcgtcctcacgaagattccgtcttctcaaagaccgccaacttcctggaacgatccgcttcgacgccaggaaatagtatatctatcaacgagctgttgtccaactcagaggaggcagaggcagatcattccgagactcatgctcgcaagccaagaaattttatcgcatccgtggcgtgcgaaaactgtcgtcttaaaaagacaagatgcgatgaatcacggccaaaatgcgggctatgcaaagccctaaacctggaatgcgtctacagtgaacgtaaactgtccaaaaaggaccagtccattggaatgatcataagcacattacatcgcattgagacgaagctagagaatcttccgtccgtgatttccaatgatattcgacctatcacaggtcatgtcttgcaggcagtggaggctattcaagcatctgcatcaaccacagcggctgggactccaagtgcgaggacgtcgtcgcataagttttcgttgtcacagaatacctcgccggctgcgaccaatctgcttgaggcggaaacacagggatcagtggacggtaaagaaatcatctcattcagccagcatggagtcgtggtttggccgggaatcatcgaacgtctaccgcatgatttcctaagtgtctacgagcaaatcggaaggaactatgttctcgacgtcgagctagagaggccacctcttcccatgtgggtgaattcgccatttgggttaccgaacactggcaattggctagaagagttgcccttcgcgcttgtaaaagggttatgcgaggcgttcttttcgttgtttcacccatttactccattcatggacaaacacttcttcttctcacttacgctcggcactgtcatcaaacatggcttttccacgacgatcgagacatgtttggtgttgaatgtgatggcgttgggctgtttagccgtgcgcgcgtacgaagaagcggatttcccactaccgggcacgatgggcgatcattttgagcgacctgcttggtttgaagcagtgctggaagatccacctggattgtcgttcttcaacgaggctcggaaacggatgggctttctcatggagaagaacaacttgtctagttgccagtactatcttttatcagcaatgtactatacgcagattattcgaccacttgattctggtgcaatgcttaatagagccgctacttgcttgtgtttcatgttagcgaaccgcgatataaattacaatgaatgggaaggtgacatgaagtccagggtattctggaacacagtcatgtacgagacgatcctcgtgcaggagctagatcttccgcccagtggtctgttgtctcttgaagacaacgtccccattccgaaattcattccatttaaactatcctcagagatcacgcgattgccggatccagatgagtcgtactaccatcaatgtcattttctggcacaaatcgcaaaccggatcattcttactcgaatccgacatagtctatacttattctccgaatccggaaacctccctcgcccagccgtcagcatagaactccacaaacaagtcgaagaatggcgcaaaaaccttccctcagtaatccaattctccgagaaaaactcagacactactctaaatgatgaccgctccccttccattagcggcacaccacgaaccccgacttcactggcagtgttagtcgctgactcgatgcttcgagcccgctatcgaatctgcaagtttcacattggccgaccatacctatacaaagcgctgagaacaccaaatctcctgacggatgaggattatgaacagatccgaagcggactccggttcgctatggattggcctatgattagaggcgtttttaggctgatgagaagttgcattcctatcagattcgctttttgttcgcaattcttcggccagctactcatcttccacggcatagcaaactcagatgagccacgattgcgtgcgactttgccccctggttgggaaaggtggtacgacgagatggtggagtttctagaatattgttccgcgtacagtcctgctattagtcgggatatggatcttgttcggcttttataggcccccttgaaagatttgaatgccgtttggttttaggagtgtatagatatgatgttgttatgttggagtgcgacttcttatgtggtctgtcaacttgccgtttttttcttcttctaataccgaagacctctcaatcaatacataacatgcatcctgcctttccttgatgatggaaagaaatgtttctattcggtgtacgattataaagttgctctaccaaagcactccccattgatgtacagtagaacctgcctataacgaacagaaggcaccctcatcactatatcggtatcagattagatgttatacatattattgaatat

SEQ ID NO: 110 - DNA, 1488 bp, Aspergillus flavus
atgtctgggaaaacgtcagttgttggactcgcctcttgggctaacccacccacgagtatctcaacgatgccaaaggtacataccactcctgcgttacatctgctacagtggcctttgattcgggggttggtggccggcccctatgaccctcatacactattgcaactggaaatggctcgtgagccccttaggatgaaagcccctaaggagttggacttaacaaatgcaacgatctatatcaggaatttttttcgacgtgtcaatgtttggtacgcctgcgttaatccatatacatggtctcgatattacaaaaccgccgtgtcactcagctttcgtgaaggatctgagagctgcctggtcctcttggtcttggctcttgggtgtgctagtcactatggcagcatttcctctgtctcgccagacaaggaggccccaggcctaccctactttgcggcagcttgggaccttctccctatagttatgatgcgcaactctgtgcctgctgcacagtgtatcatactggcatcagcctatttattctacctagtcagacctctagaggcctggacccttctgtcaaatgccagcttaaaattacagctccttttcggcaatccatctcgtgttcctcttcagtggaaggaactaagtgtgcgaatatactggaacgctctgctctacgaaagcgacttgctagcggaactagatctaccacattcgggaatcgtccactttgaagagctagttgatctacctggggggtttgaggaggaggatgacgaagagtaccaagaggctgaggatgcacatggtgaaattgcatctgaaactgagcctgttggtcacgatgaattatggtacttcctagcagaaattgcattgaggagattgcttaaccgtgtcagtcacatggtttatcaaaaggatagcccattaactcttggaacacttggacctattgtttccgagctggactatcaactctctcagtggtatgagagtctgccccaacctgttcagttccctctctctcgtacacctgtgtcaaactctgtccagactgccctacgacttcgatattttgcatgcaggacaattatctaccgaccttatatgttggctgtttttgaaaatgagcagacatctttagacccagtggtaaaggagtgctgccggcggtgcatagaagccacaatacaccaactggagaatataacaagccaccgcgaaggtcatctaccatatctttggcagggagccttgtccatggtgtcacaaacgctactgatcatgggggctactatgtctccaacgctttctgccttgctgccccctgcagaccaagtagatcggatgatatcagaagtagtggcagaggtcgagagatacgcccaccttgccccgagtttaaagctatcagcagaaatcattcgggatgcagaaaaaagacgtcaaatctgtttgaggtctacagggcgttgcacttaa

SEQ ID NO: 111 - DNA, 2030 bp, Talaromyces stipitatus
acagtagaacctggctataacgaaaggaaggtcgcttcatatttctactaatcttagcttggattaatttaatatgggattgaagagcatcctactcacgaatattagaatagatattgaaggaccaggttctactgcattttatcctcgaccaaagaatgagctatacgcgtaaacgggcggcattagcttgcatattctgtcgcagcagaaaacggagatgtgacgcacggaaaccatcgtgctctaattgtcttgatttggacgttgagtgtcactacgatgacactccatcgcaaaggattgatacttctggaggcagtcgggagattctcaatcggttgcgaaatatcgaggcaatcctccagagtcaatcagagcggataacagctctttctaatgagcctcaaagaacacccttgcatgttcatgatgccgtcacaccgcggagtcagcagtcagttgcaatcgttgacatgcattcccaaacgtggtcatcgtcacaccttaatgccccgtctgactactcaagcttgccgcctctcaccataccagtcaaacacaagacttcatctacatatttattaaatttgcctgcggtcaaatcactgatcggggaatacccgacagatctcttcttcagatttgaattgcgaagtcatcttcctcctcagctctcactggaacattcccatgcagcgtctcccgtcaatatacagagggaaatcacagacgaattgatattattcttcttcgcatacgttcatccaaaccatccggttctagaccgcgaagagtttcaaaagcactatgctcgattcctcgagaatgggcctgatcatagctatgaatctattctctgtatggttgttctggcattaggagccgttgtttccacagccccggaccctgaggtattcaagtcgtcacctccgggtatggattacatgcagtacgctatgccgacgctgctctctgtttctgcatggtctttttcttcaagtatgttggcggctcatgcactggttcttgccagtgtctattttgcctacattgttcggccactacagagttggcggttgattcactctgcttcaacgatgttgcaaattaatcatgtcggggtggattctcttcagaaaatatcgaatggttttaatgaaggagagcatcttgtccgccttttctggtcatcatttctcgtcgagtgcgaccgtctcgcggagcttgagctcccacgaagcgggctcgaagagttaacagacagcatatatcttccaaactgtacaaaccttgggcttgcagaatctgcctggtatctcgctgagatatccatccggcggttgctcaatcgcattcataactccttatacccaggcaagaaacagccactttcgaagcctccaatcacatctcttgcatctgatgacttttcaatggaagaaatagtttcgattgatggtatttgtaatgaactacgctcacagctggagacatggtatttatctatccccgaaggtctccgtcctgttctagaaaatgctaatgaggaggataccgccggtcgacaagcaattctgaggattcgctattttgcagccaggcatatcatctacaggccatttctactttgcgttgttacgcacggctcgaaacgtgccccgcggtcaatggttgaaaaggctgctatttgcattgagagttgccgatggtacattcaccatactaccaaggtgttgggaaggccaagtcagtacacgtggacattcgcattatcctcccttggtgcgattataattctcactttaggctccttgaatcgagatttgcaagcctttgtgccagacattgacgagctacagactatggcaattgacaactttcgaccgtgggcattctcaagcctggaagcggtcgtatcaatactagaggatatcaggaaaaagaggaggcttcttttacaagtgtgaacttgattatataatatttaaggaagtagttaagttactttaaattcgtgtcatctacaa

SEQ ID NO: 112 - DNA, 4928 bp, Penicillium chrysogenum
atgactgtacccaacgagagttccgaggatgtcaatgatttccttcagcgcatccgggaactaggcgaacgccgcgacaaggaagatgacgagcgcactaaaaagctagaggaggagatcctgcagggccggaaggaaaggcaagctcggagagctggtcgacaatgtgctgatatccggatgactcaaaaatagaacgtgcacgatcactggcccttaccgacgattcacccaccctcaatgttgcgcgactgagtgcttcctctattagtccccggcccatcgaccccccggaacacctcgagccgacaccgcaaacaccgcaaacgccagcacctgagccaaccctgagcgccgtggagtcgagccaagatatggaggtctccaacaccgacaagcggcggggatcggtcccagatttcggaatggattctcccacgcggacacgttcacccttgtcccgcagccgcgcggggaccttgtcatggcagcaacgcccctcgcgtgatttcgccgtgtcgcccggttcaacatccccaacccgctcaccaactcgcgcaagccacctgagaaatttgtctacggcatcggacgagaactcactatctcgactccaatttgggttcccacgaccatcgaaggatgctcctgtgctccctccatcaccggaccgtggggttgggtcgttagcgcacagtgcgaaggaagaacagacggatagccaaacagacgtgggcgtggggcatcaagagccagaagcgggtgaagaatcgagtaccgaactagataaacttgaggcagtagaagagagatcatcgtcgcctccgagaaccggttctcgcgatagcaacatgagccatcgcttctctgtatcatcggtttcggctgggttggggtcgccagtgcacctgtcagagactccgaagctcgagcctcgacagaatgattcctccctcgaggaatctgtgtcgccgtctccagcccagcggcggctgtcaccagaacgaacgcggtcgacctcacccaccaagggcctgggaggcttcgttcagagtgctatgatgagaagatcagatagtgtgtcaaaaaggtggagtgcacaagttccgcaggggcttgggcggtcaaattccattgtgtcaaatcgcagcagtgtggcaggtccaagtttgagtgaaatgacccctccaactctggggcgaattggacgtgaaccttcaactctcctgcaacgaccaggctccagccacagtgaggcagccaccgcaacaactgagcgaccaaccacacctgcggatagagacagtgtgaattttgaaaccagtccaggaaaatcattccgaactggtcattctcgttctgctagctctgctaccgcagaaggcagcgaagcccaaggtccctttgtctcaaaaaccatggatcccaggcgctggagccccaacaaggcttcttggttagagagtgccctcaaccgaccagagctaccacgacagaccaccagacccccctctcagcccaactgggccaaagaccggcagtcgcgaggtagcgtagatttgggacgagtaaacaatttcaaggaagtcactcctatcggtttgatgcgaacacccccaccagggactcaaacgaagctacctggtgtttctgtcccacaatctccgtcggttctcggtagccctgacgtcggacaaacgaaagaggaaacctcagcttctccaactcctgtcgaggaagctctcaatgctctatcaggcggcgcaccggcggaggaacataagcctgcctcccccgctgaaatggagaatgaatcgcaaaaagtacccgcgtctgaagagtctgagcctcaatctactcccactcgtagggcccctcccgactcgttgagccccaaaccaaacttttccatctctacttcctcgcgcggacccatttcacccaaggcgaagccacaatctcccgtgctggacttccgagcaaacctacggaaacgagaagttgtcaaagataacggagattccaaagaaccagaattcaagaatgtatttgggcgcctcaaaaagaccgaaactcgcaactatgttgcccctgatgagctcaagggcaatatactacgaggtaaagctgctttgaacgctaccggcggaccgaagaagacagagcgagtcgatgaatttaggaagagccttgtgtcacgcaaagatgaaatgaaagccggcggaggctccatcagacggaataccgctggagagcaggatgcgccgccaaaacaagccgaggtcgtaccagaagcaattgctatgcgacaaaatatgacccgggcaaatagcatcaagcaaccacctgtggatgcgctgatatcgcctactaaaagctttggttctcgagcctcgcaggacagaccaccattgtcgtccccgaatacacctctcaaaggcattgttccgtcgcgagcttctcaggaacaacaaccattgtcgccatctcctgccaatgatgagccgggctggcccttgaaagataccaatgcctcgcgtgcatctcaagaatcacaaccattgtcaccgttccctgctgatgatccgattgatgagccagagggagcaattccggcggcgagcgaccacaggcaaacaccggaggcgatatcttcaacaaaccaggaggacacgcgcgaagttgtggcgccagtcgagcccagcatagtgaagatgcaggagccttcagtcaagacactccggccagttcgtcaatggccaccggcccctgtcgaggaggctactgtgactccaagtccggcaggtaaaagcaaattggcgggccgaatcaatcctgcgctagctggccttctttctcgtggcgcgcccgccgctgacggaccgaagaagcagctgccaacccctgtctcagcacagagtgaccctgcttcgccatctgcgcctctcacccacatgacaaagggtcgtgctagaggcccgaagagacgacttccccagacatctgatgcctcgacgccgtccgctcgggatgatactaaggaggttggtgctatttcatgctctgaagccaccccgtcacagactcctgcaatccctgttgaatccctggacattgattcagagcacctgtcgcagcctgatgaaaaccctgttcctgacatcacgaactcctgttcagacagcacaggcaccgagcaacttccggaagtaaacactcctctccaggatacccttgaatgcgatacgcccgaaagcgcattcccgcaagcacttcagacacgttctctaacatcggatttcgacattttcccctccgccgatcttgaggcgacgcccagggaacccgaaagccctggagaggtgagtccatcaggcggaccgcctgtcccgccgaagtccgattctccctcgtcccccttgcctgcaacgccaaagccacaatggggccagcaaaaccggtttgcgtcctcgtcgccgtcccctctccgaaccagtcacaatgagaatcaaatggattcacctatgaatcaggagaagagcatccccggggttatcgtcgagtcagcacgcagttccgtctcacgacccatgagccatccctccccgccagtaccccctaaagacggcgatgttatgctccacaagccaaccgatccgcgcagactttcaagaaagatgtcggctccatcactggttgcgcaagccagtgaggcacgtgaggtaattgccggcttcttcaagacattcccccacgctcgaaaccggatggacattgatccgcagctaatgctgatgcgtaaaccggacgatataaagatcaggaccatgaagctacatatatgggagctcacaggtgatgggaggcgtcaagaacttccttcccaccaggagtacatcctataccaaggtagcatgtatctctgcgtgcacacatttgagaccggacggagtagcacttcggaagtatacctttggcgcggagacgacgtccccgaatcctcggtggagaatgaacaacccttcgcacgcaagatcgctcgtgataatagctccaagttgcaagtcattcggcagggcaatgaacctacccggttcatccaagcgcttggcggcatcatgatcacgcgtcggggatccagctctcgccacaattcgtcggctctctacatgctttgtggccggaaacacttgggcgagatgaccttcgatgaagtggattactcactgcgcaatctctgctccgggttcccttacgttgtctctgctccctttggcaagctctacctatggaagggcaaaggtagtggccctgaagagaccggcgcagcccgacttatcggcatggacctaggcctgactggagagttcgaagaagtcaacgagggtgaagagcccgaggatttcttcgatgtgttcgcaggccccagggaggctgcgccgcacatgtgccaagatcactggcagctcaagccgaaatacaaccactaccgcacgcgactgctccgggtcgaccacgaactgaacccgccaactcgtttctggaatatccgccgtccgggctcaagttcaccagtggtcaaggccaacgattgcgttcaagaaatcgagccattctgctaccgagatatcaccgagaaagacgtttacgttctggacaccttctttgagatctacgttattatcggcgatcaagcctcacagaagtctgccgatttcgcctcggcagtggtcttcgcgcacgagtatggtatccttgccacatccctccaggaccgaccattcattcccaaaagtttcgtggccctcggtggcgtccccgaccgctgccaaagcgcattccgtaaatggaacccacgcacccagcatgcgcctttcgtgttctctcttgatgttgttatcgaggcgattcggtcaccagagaattga

SEQ ID NO: 113 - DNA, 1554 bp, Verticillium albo-atrum
atggcaagcagagatagcttccacatcgaagtaccttcgccctcattgacggctgtaaacggcactcatccgctcaagtcaccctcgtcgctcaaaaatcatcgcacgcccagctttagccgggatggtctgatcagtgccgtgcaaaaggccagaaacatgtctcaatcatccgaccagcgtatcaacggcttcagtgatatgaacaaaacacccagtgacgaggggtcgaacccactgaagcgccgcaacaccgatgccggagttgactatccgcgaaggagggctaccatcgcttgcgaggtgtgtcgatcccgcaagtctcgctgcgatggcaccaagcccaagtgcaagctctgcaccgagctcggcgccgagtgtatctaccgagaacccggcatcaagctggatgcaggcgacaagctcattcttgaacgccttaaccgcatcgagagccttcttcagatgaacatgtggcctttaattcgcgaccttgtgtcacgaccgtacgatccgcaaatcctgctacagcttgagatggcgcgagagccgctgcactcgctgacgaagacgccgtgtgtcgacctgtccaacactacagcatacatcgaagcctattttgaccacgttaacgtatggtacgcttgcgttaacccttacacctggaggagccactaccggacggcgctatccaacggcttccgcgagggcgccgagagctgcatcgtccttcttgtactggctctgggacaggccagcttgcgaggaagcatctcacgcatcatgcctggagaagacccccccggactgcaatacttcaccgctgcatgggctcttctcccgggcatgatgacttcaaataacgttctcgcagcacagtgccacttgctggcttctgcgtacttattctacctagtccgccccttggaggcctggaacctgctttgtactaccagcacgaagctgcagcttcttctcatgtcaccgaacagggtaccgcccaaccagcgggagttgaccgagcgcatttactggaattctctcctcttcgagagcgatctgctggcagagttggatctcccgcactctggggtggtccagtttgaagagaacgtcggacttcccggtggctttgagggagaagaacaggaagcgattggacgggatgatctttggccctacatcttggctgtcttggacaatgagcaggctatcttggaccctgcagtacgagacagttgccacaagtgcttggaggcttctgtgcgccaactggaacacatctctgcacaccatgcaggccacatgccctatttgtggcaaggtgcactctcgattgtatcccaggcactgctcgtcatgggcgccaccatgtcaccctcgttgggtagcatccttctgacgctatgcggtagccgtgaggctatcgaccagatcatcaatgacgtcgttatggaggtcgaacgttattcaaacctagcgccgagtctgagcttggcggctgagatcattaaagaagccgaagtgaggaggcgagcattcctcagcgggtga

SEQ ID NO: 114 - DNA, 2100 bp, Nectria haematococca
atgtctccatcttcgacgggcgaatctcctcactcagcatccatgactgctgcggccaggccgtttgccgtcccttcacgcgacagcttctcgctagaaattccggcggcttcactcacagccatgtccaacgagttaggaataaaatccccagttactttcaagaaccagcgcacagctagtttcagcagagacaccatgttgagctcagcacaaaaaccccgtcatctatcccagtcatctgagaacagaaccgatacaatgaccaacggcacacaaaaactcccgagtgatgaaggctcgaacccgctcaagaggaggaataccgaaacaggtgtcgactaccctcggcgcagagccaccatcgcttgcgaggtttgccgttcgagaaaatcccgctgtgatgggactaagcccaagtgcaaactatgtaccgagcttggtgctgaatgcatctatcgagagccgggtatcaaactggatgccggcgacaagctgatcctcgagcggttaaatcgtatcgaaagcctgctgcagatgagtatggtgagcacatcaccaaacggtcttaacttgacccaagactcgcctggcatgagcaatggcacggggcttagtggtgacaaccttgttatggccgtcaaccccaccaactttgtctctattcccaacggtggatttggcacatggtccgcccagcccattggaaccaacatctctaccatgcccaaggttcacaccaacgctgctatgcatttgttgcaatggcctctcatcagagatttggtttctcggccatatgatccgcaaatactcctccagttggaaatggcccgagagccgcttcattctctgacgaaaactccttgcgtggatctctcgaacacccaggcatatatcgaggcttacttcgagcgggtcaacgtttggtacgcttgcgtcaacccttacacctggagaagccagtaccgcaccgccctttccaacggtttcagagaaggaccggagagctgcgttgtacttcttgttttggcacttggccaagcaagtctacatggaagcatatccaggatcgtccctcaagaggacccacctgggttgcaatacttcacggcggcctggtcacttcttccgggcatgatgaccgccaacagcgttgttgcagcccaatgccacctacttgctgctgcatatcacttttatctggtccggcccatggaagcgtggaaccttctctgcactaccagcacgaaactccagctcctcctcatggcaccgagccgcatcccgagccatcaaaaagagcttgtggagcgcatttactggaacgctctcctgttcgagagtgacctactcgcagagctcgacctacctcactcgggcgtggtgcaatttgaagaaaacgttggcctcccgtgtggattcgaaggtgaagagtcggagcaggccgttgggcgtgacgagctttggtacttccttgctgagattgccctgcgtcgactcctgaatagagtgagccaactcatctattcgaaagattcgatcgcatcaacaacaagtttggagccagttgtcggggaactcgactaccagctaactcagtggtacgaaagcctgccattaccactgcagtttccctttacacgaaccgtccttcaggaccctatccaaacggtgcttcgacttcggttcttcgcttgccgcacaataatctaccgaccatacatcctggcagtattggacaatgagcaggcagttttagaccctgctgtgcgggagaactgtcacaaatgtctcgaggcttccatccgccagttggaacacatccacgaacatcatgctggacacatgccatatatctggcagggggcattatccatggtctctcaaactctactcatcatgggcgccagcatgtcaccgtccttacttggcatcttgctgacattggtgccccatcgagaagctctggatcaaatcatcaacgaggtggtcctagaggttgaacgatacgcaaccctggctccaagtctaagcctagccgccgagatcatcaaggaagctgaggtgagaaggcgagcgtttctgggaaccccctag

SEQ ID NO: 115 - DNA, 2139 bp, Pyrenophora teres
atggcaggaatcactccttctccagacgttagtcccgtatcgtcagcaacgaccaatggaggcttccccagggatgccttctccctcaatctctccactttgcccgacgccaacagctttatcctcaagtctgccctgacctctcctcatcttctcgactccccaaacggtctcttctcaggaggcggccgtttgagtaatcccttcaagaagcggccccgcaacatgtctcaatcatccggtactgatcgggaaatgtcaaatgaaaacactccacccgcctcaaacggtattgcacccacaagcaacgggaacgacggctccaaggcagagccccggccagctacaaagaagcgcccaagtaccgacacaatagactatccacgacggcgtgcgactatagcgtgcgaaatatgtcggtcgcgaaagtctcgctgcgacggcacacgaccaaagtgcagactttgcacagaactgaatgccgaatgcatataccgtgaacccggtatcaagcttgacgctggcgacaagctgatcctggaacacctgagccgcattgaaggccttctacagtctggcctcaccagtaactattcattgtcgtcgcattccccagctgcgagcaactcaacgagcgacgattttctcgctcgcagtaccggccacataccccatctcggtatggttcagccgatcaacggcataggaacatggaccaatcatccctcaaatatctcgaccatgccaaaaacacacaacacagcagcgctgaatctgctgtcctcacccatgatccgggaactggtgtctcgtcaatatgatgccaagatactccttcagctagagatgacccgtgaatcagtaagcctcggtacaactcgcggtctagacctgtccaacactggtgtgtatgtccaagcatactttgagagagtaaacgtcttctacgcagtcgtcaatccatatacatggagtggccattaccagactgcactcagccatggattccgagatgggcctgaaagttgcattgttctcctagttcttgcgctaggtcatgctgcaagcaccgggagcataacacaacagaacccagacaaggatccccccggcttggcgtactttgccgcagcttggagtctgttaccaaccgtcatgacgaggaataacatggtcgccgcgcagtgtcagatccttgctgcagcatatctagtgtaccttgtccgtccggtcgaagcctggaatgtgctatcgggtgcgagtatgaagcttcaacttcttctaagtgcacctggcagagtgtcgccagcggaagaagaacttggcagaagagtgtattggaatgccgtcatgatcgagagcgatcttctagcagaactagatcttcctcattctggcattgcgcagtttgaagagggcttttctttgccaaccgggtttgaggatttagggaccgaagcagttggtcgggatgagttgtggtactttcttgccgagatcgcccttcgaaggttgctcaatcgggtgagctcgatgctctacatccggacgacaccgtattccaaaggcccggctgccacctcgattgctcaactagacccgctcgtcgtggaactagattttcaattgaatcagtggtatgccggactaccaccagccatgcagttcccactcgatagggtaccgttacaaaatcccgtgcaaacagttctcagactacgctactttgcatgtcgcacaatcatctttcgaccatacgtactgcttgtgttgcaggatgaaagcctggcaatggattccggtgtgcaggacaactgccacaagtgcctggaagcatgtgttcgtcagctagagtacattactgcgcaccacgcgggacatatcccctatctgttccagggcgccctctccatcatctcccaaactctgctcatcatgggcgcaaccatgaccccttcactttcccagctgcttcctccaccggcgaccatggacgacatcataaacaatgtggtccttgaaatggagcgctacgcacatcttgcgcctagccttcgtctctccgctgagattattcgcgaggccgaaggaaagcgacagatgtggttacggacagcgggcctcaagttcgaagtatga

SEQ ID NO: 116 - DNA, 2133 bp, Sordaria macrospora
atgtcgccgtcttccaacggcgactctcccgcttcggtagtgggcagcatgaccatggccgcccaggccgttcctaacgctgtaaggcaataccctctgccgaatcgagacttcacaatcgaaataccctcgccccaacttgcacccactgtcaatggggtcaacaccataaagtcaccctccactctcaagtctgcccgtgctcccaatttcagccgggaaggcattcttggatcggcccagaaagcccgaaacctctcgcagtcgtccgaaaaccggcctgacaatgtcaacgtttctaatggttatcaaaaggctcctagcgaggagagcaccaatccgctgaaaagaagaaatacggatgctggtgtcgactaccccagaaggagggcaaccattgcgtgcgaggtatgccgctcgagaaagtcgcgatgtgacggcacaaaaccaaaatgcaagctgtgcacggagttgggcgccgagtgcatatatcgcgagcctggtatcaagctggatgccggcgacaagctcatcctcgaacgcctcaacaggatagaaagtctgctttcgataaacatgggcttagccagtcataccaatggcctagggctatcccataactccccggggatgagcaacgggacagggctgagtggtgacaacctgatgatgcaaaatcctgacgccgcctgctttgtctcggtgatccccagcggaggactgggcacatggtctgccaccgccaccaacaacttatcgacaatgcccaaggtccacacaaatgccgccctccacttgttgcaatggcctatgattcgagatcttgtttcacgaccttacgacccacaaatccttctccaactcgaaatggccagggagccactacactcgctcacaaagaccccctgtgtggacctttccaacaccaccgcctacatcgaagcctattttgatcgtgtcaacgtttggtacgcctgtgtcaacccctacacatggaggagccactatcggattgctctctcgaacggtttcagggaaggaccagaaagttgtattgtgcttctcgtcttggctctcggtcaggcaagcctaagggggagcatatccaggatcgtgccacacgaggatcccccgggcctccaatatttcacggccgcttgggccttgctaccgggcatgatgacctccaacagcgtcctcgccgcgcaatgccaccttttggccgccgcctacctattctatctcgtccgacctttggaagcatggaaccttctctgcacaacaagcaccaaactgcagctcctcctcatgacgccgaaccgggtgcctgtcgaccaaagggaattgagtgagagaatctactggaatgctctgctgttcgagagtgacctcctcgctgagctagaccttccgcattctggggttgttgcttttgaagaaaatgtcggtctcccatgtggctttgaaggggatgagcaagaggcagttggtcgcgatgacttgtggtattttctcgccgaaatagcacttcggcgactactcaaccgcgtcagccagctcatttattccaaggactccctggcctctacaacgagtctcgaacccatcgttaccgagttggatttccaattaacgcagtggtacgagagcctgcctctaccgcttcagttcccttttactcgggcaatgctcccagatcctgtccagacggtgttgcggttgcgcttctttgcttgccgaactattatttaccggccatacattctcgcggttctcgacaatgaacaggcaatactggacccctcagtgcgtgaggcgtgcacaaagtgtctggaggcttcaatcagacaattggagcatatcagtgcgcatcacgccggacacatgccgtacctttggcaaggggcactctcgattgtatcgcagacacttctgatcatgggtgctaccatgtcaccgtcactcaacagtattctggtgagcttggtctcacaccgcgacgttatcgaccagatcatcaacgatgtcgtcatggaaatcgaacgttattccgtactctcgcccagtctgagcttatcggcggagatcattaaggaggcggaggttaggcgacgaacattcctcagcggttga

SEQ ID NO: 117 - DNA, 1929 bp, Magnaporthe oryzae
atgtcgccatcgtcgacaggcgagtcgccgcctacgatattaaacggtcattcggcaccagcactaaacacttccaaccctccaagcgccctgaagtcgcctgcaaccgtcaaaagccaacgcaccccgagcttcagccgcgatagcattctcggatccgctctcaaggccggcgcctctcagcgggctgatttttctggggacggcaggctaggagatcctaatgggctgcagaaggtttctagtgatgaagggtcaaaccctctgaaaaggagaaacacggacgctggtgttgactatccgaggcgacgagcaacaatcgcctgtgaagtatgtcgctcccgcaaatctcggtgcgatggcaccaaaccgaaatgcaagctctgcctggagctcggtgccgactgcgtttaccgtgagcctgggattaagcttgacgcaggtgacaaactgattttggagcgcctcaaccgtatcgaaagcatgctgcagatgaccctgccaccaaatggcatcggtctgggaggttcgccgaacctgagcaatggaactggacatctcagtgcggatggcattctaactggtggtccatttctctcggtcatgcccaatgctgcattgagccagtgggcaactgctcccaacatttcgacgatgccaaaggtgcacaccaatgcggcactgcatctcctacaatggcccctgatacgagaactcgtatcgaggccctatgacccgcagatcttacttcagctcgagatggcaagggagcccctacactccctaaccaaaaccccttgcgtcgatttatccaacaccgcagcctatattgaagcgtacttcgagcgagtcaatgtttggtacgcctgcgtgaatccttatacttggaggagtcattaccgcatcgctttgtccaatggtttcagagaaggtcccgaaagctgtattgttctcctggtgttagcactcgggcaagcgagtttgaagggcagcatatcccggattgtgccacatgaagacccgccgggcctgcagtacttcaccgctgcttgggctctactgcccggtatgatgacatccaacagcgtcttggctgcgcagtctcatctgcttgccgccgcctacctcttctacttggttcgacctcttgaggcatggaacctcctctgcacaaccagcaccaagctacagcttcttttgatgtcgccgagcagagtgccttcggatcaacgagaactcaccgagcgcatctactggaactcgttattgttcgagagtgatctcctggctgagctggacttaccccactctggcgttgtccagttcgaagagaatgttggtcttcctggaggctttgagggcgatgagaacgaagcagttggccgcgatgacctgtggtattttctcgccgagatcgcgcttcgaaggttgctcaaccgcgtcagcaaccttatctattcgaaggattcaatggcctctaccactagcctagagcctgttgtggcagagctcgatttccagctcacgcagtggacgatcatatatcggccctacattcttgcggtactcgacaacgagcaagccgttttggacccagcggtgagagacagctgtcacaagtgtttggaggcttcgatcaggcagttggagcacatagcagcacaccatgcgggacacatcccctacctttggcaaggagccttgtctattgtgtctcagacgctccttgtcatgggcgcaactatgtcaccatcgctttctagtatattgtccaccgtggttccccacagggaaacactggatcagattctaagcgaggtgattatcgagatagagcggtacgccgtccttgcgcccagtcttagcttggctgcggacattctcaaagaagcagaggtcaggaggcgagctttcctcatgagtgggtag

SEQ ID NO: 118 - DNA, 2091 bp, Gibberella zeae
atgtccccatcatcgacaggcgaatccgctcactcaatctcaatcaactcagcccgaccattcaccgttcccgctcgcgacagcttcgcactcgaccttccaatgtcgtcacttgcaaccatgtcggccgacgcctcactcaagtcccccgtcagttacaaaaatcagcgtacgcccagcttcagcatggtcacgtctcaaaaagcccgccacctatcgcaatcctccgataataacagacctgacaatatgtccaacggtggacaaaaggtctcaagcgacgagggctcaaacccacttaagaggagaaatacagaaaccggggtcgattatccccgccgcagggctactattgcttgtgaggtttgccgttcgagaaagtcgcggtgcgatggaacaaaacccaagtgcaagctctgtacggagcttggcgctgaatgcatctaccgagaaccaggaattaagctcgacgctggtgacaagcttattttggagcgcctcaatcgcattgaaagccttcttcagatgagcatggtaaacacaacagcaaatggacttggcctgactgaaaactcacctggaatgagtaacggcaccgggctcgatggcgacaacctgatcttgtcagccaatgcggccacgttcagctctatccctaatggcggatttgggacttggtcggcgcaaccagtgggaaccaacatctctaccatgcccaaagtccataccaatgccgccatgcatctactgcaatggcctctcatccgagatttaatttcgcggcaatgcgatcctcaggttctgctacaattggaaatggcgcgagaaccgcttcacactcttacgaaaacaccatgtgtggacttgtcaaatactcaagcatatatcgaggcctattttgagagggtcaacatatggtacgcctgcgtgaacccatatacttggagaagccaataccggaccgccttgtccaacggattccgagaggggccagagagttgtatcgtgctccttgttcttgctctaggccaagcaagtctgcacggtagcatatccaggattctcccgcacgaagatcccccaggtctacaatactttacagcagcttggtcattgcttccgggattgatgactgccaacagtgtggtggcggcgcaatgtcatctcttggctgcagcgtaccacttttacctcgtacgacctatggaggcatggaacctactttgcactacaagcaccaaactgcaactccttctcatggctcctagtcgcattcccagtcaccagcgagagctcgtggagcgcatttactggaacgccttactcttcgaaagcgatcttctcgcagaactcgacttgccccattcaggtgttgtccagttcgaggagcacgtcggccttccaggcggattcgaaggagacgagtcggagcaagtcggtcgagatgagctctggtacttcttggcggagattgccctccgtcgtttactgaacagagtcagccatctcatttactccaaggactctattgcaaatacacagagtctagacccagttgtcgcggaactcgactaccaattgagtcagtggtacgagagtctgccattgccactgcagtttccttttacccgaaacgcccttcaggaccctgtccagacagtacttcgcctcagattctttgcttgccgcaccatcatttaccggccgtacattctagccgtgctagataacgagcagcaggttctggatcccgccgtgcgggaaaattgccacaaatgcttggaggcttcccttcgccagttggaacatatacacgaacaccatgctggacatatgccatatatctggcagggagctttgtcaatggtgtctcaaaccctgcttattatgggtgccaccatgtcaccatcacttctcaatatattgcttacattggtgccaagtcgtgaggcgctagaccagattatcaacgatgtggtaatggaagtcgaacgatacgcgactctggccccaagcttaagcctggcctccgaaatgctcaaagaggctgagtactgcttcagcatcattagtcccagagtcttggattaa

SEQ ID NO: 119 - DNA, 1899 bp, Aspergillus nidulans
atgtcttcctctccggagagagatagggaaggaatcttggattccacctcagcttcactaaacgagttaataaacaagaagcgctccaattccgaagcaacagaatatcctcgaaggcgcgcaaccatcgcttgtcaaatctgtcgtctacgaaagacgaggtgcaacggagctcgtccaaagtgccagctctgcactgaccttgatgcagaatgcgtctaccgagaacctgggatcaagctggatgctggggacaaattgatcattgaaagacttgcaagaattgaagggctcttacaaaccagcttagcagcacaaaactcacagcttacgttgtcttcgacttctcccgcaaccagtaacggaaccaacgttgggagcgacgacacggttgcgaaagcgtcaactcatctggcggtaaccgggagaactacttccattgtaggactcgcctcatgggcgaacccgccgacaagcatatcgaccatgccgagagtacacaccacgcctgcattgaaccttttgaaatggcccctgatccgggacttagtggctcgaccatatgattcccagacccttttgcagttggaaatggctcgcgaaccgctgaaaatgacacctcctatggccgtagatctatcttgtgcgccgctttatatcagaaccttctttgagaaagtcaacgtctggtacgcctgtgttaatccatacacctggtcaaaatactatgacgccgctgtatccctcagctttcgagagggtccagagagctgtgttgttctcttggttctagctcttggttgcgccgctcaatgcggcagtattgctttaatatcaaccgacagagatcctcctggcgtgccgtattttatagcggcctggaatcttctaccatcagtcatgatgcgtaattcagtcgtcgccgcccaatgtatcatcctggccgctgcttacttgttctacctggttcgaccactcgaggcctggacactactttcgaatgccagcatgaagctacaactattattcggcaacccgtctcgtgtgcctgtccagtggagagagctgagtgttagagtgtactggaacgccctactgtacgaaagtgatttgttggccgaattggatttaccgcactctggaatcgtgaattttgaagagctggtagatcttccgggcgggtttgatgagatcgaagatgatgaagacgaagacgacggcgatactggcaacaaactggtcagtcccattggttgcgacgaactctggtattttctagccgagatcgcccttagaaggctactcaatcgagtcagtcatatgctctatcagaaagacaacagcctgacactggcttctctagcgccaatcgtctcagagttggattttcagctgtcccaatggtatgaaggcctacctcagcccgtcagatttcctctgtcccacgctcctatatcacatccagtgcagactgtcctccgactaagatactttgcctgccggacgatcatctaccgaccgtacatcctggctgtcttcgagaacgagcaagcttcaggggattcgtgggtgagggaatgttgccggcgttgcttggaggctacgctttatcagctggaaagcgtaaccacccatcgtgagggtcatctcccgtatttgtggcagggcgctctatcaatggtctcgcagtcacttctaatcatgggcgcaactatgtcccctgcgctctcaagtctactcccccctactttgcgcgtggacgaaattatatccagcgttatagtggaggtcgacaggtatgcgcatcttgcgccaagtctcaagctatcctcagaaatcctccgtgacgccgaaaggcggcgtcagatttgtctcagatcctcgggaagcagagtataa

SEQ ID NO: 120 - DNA, 1902 bp, Aspergillus fumigatus
atgacgccctctccagagagagacttggtcctcgactcggccactgcaggtggcactaccgaatctcaagtcagcaagaaaaagcgatccaactcggagctgacagaataccctcggagacgtgcgacgatcgcaatatgtcgcttgcgaaagactcgatgtaacggcgcacgcccgaggtgtcaactttgtacagacctagacgcagactgtgtctacagggaaccaggcatcaaactcgatgctggtgacaaactaatcattgagaggttgaatagaatcgagggtctacttcaatctactctggtgggacaagcaactcatctcccattgtcttcaacatcccctaccaccagcaatgatacgaatgcgggcagcgatgatgcggtcgccaaggcgtccactatcgccgccatgtctgggagaacctccgttgccggccttgggtcctgggtgaacccaccaacgagcatctcaacgatgcccaaggtgcacactactcccgcgctacaccttctacaatggcccctcattcgggacctggtcgctggtccctacgatccacagacgttattgcagcttgaaatggcccgcgaaccgctgaggcttccttccgctgcagggttcgacttgtccaatacaacaacgtatgtacagtcttttttcgagcgggtcaatgtctggtacgcctgtgtgaacccatacacttggacacgctactacagtagagccgtctctctgggattccgagagggacctgaaagctgccttgtcctcttagtcttggctctcggcagcgccagtcactacggaagcatctcgttcattccttcagatatggaccccccaggactaccttactttgcagcagcgtggaatcttctgccatcggtaatgatgcgcaactctgttctggctgctcagtgcatcatccttgcgtctgcctacttattctacctagtcagaccgctggaggcttggaccctcctctccaatgctagtatgaaattacaattactcttcggggaccccgcccgtgtaccccttcagtggagagaactgagtgtgagagtgtactggaatgctctcttatatgagagcgacttgctggcagagttggatctgcctcactcgggcattgtgcacttcgaagaagttgtcgaccttcccggtggcttcgaggaggaggaggacgaagaagatgatgaagctgacaatgaagatcgtcaaagcagcttggtggagggctcggtaggccgcgaggaactgtggtatttccttgctgagatagctcttcggcgactcttgaatcgcgtcagccatatgatataccagaaagacaactcgctaactcttggatcacttgggcccattgtctcggagctggatttccaactttcccagtggtatgaaagtctccctcaaccagtccagttccccctcaaccacacaccgatttccaaccccgtccagacagtcctccgattgcgatactacgcgtgccggactataatataccggccatacatcttagctgtctttgagaatgagaacgctgcaactgatcaggtagtaagggaatgctgccggcggtgcttggaggccacgctgcgccagctggaaaatatcaccagtcaccgcgaaggccatcttccctatctctggcagggcgcgctctctatggtgtcgcagacattgttgattatgggggccacgatgtcccccggactctccagtttattacctccgggattccgagtggatgcgataatatccagtgtgatggccgaggttgagagatacgcacaccttgcgccgagcctcaaattatctgcagagatcattcgcgacgcagagaagcgccggcaaatttgtctcaggtcgaccagtcgacgagtatag

SEQ ID NO: 121 - DNA, 2241 bp, Neurospora crassa
atgtcgccgtcttccaacagcgactctcccgcctcggtagtgggcagcatgaccatggccgcgcaggctgctcccaacgttgtaaggcaatatcctctgccgaatcgagacttcacaatcgaaattccctcgccccaagttgcacccactaccaatggggtcaacaccgtcaagtcaccctccactctcaagtcgtcccgtgctcccaacttcagccgcgaaggtattcttggatcggcccagaaagcccgaaatctctcgcagtcgtctgaaaaccggcctgaccatgtcaatgtctctaatggctttcacaaggctcctagtgaggagagcaccaatccgctgaaaagaagaaatacggatgctggcgtcgactaccctagaagaagggcaaccattgcgtgcgaggtatgccgctcgaggaagtcgcggtgtgacggcacaaaaccaaaatgcaagctgtgcacagagttgggtgccgagtgcatatatcgcgagcctggtatcaagctggatgccggcgacaagctcatcctcgaacgcctcaacaggatagaaagtctgctgcaattaaacatgggcctaaccggtcatacccatggcctaggattatcccataactccccggggatgagcaacgggacagggttgagtggtgacaacctgatgatgcaaaatcccgacgccgccggctttgtctcggtgatccccagcggaggcttgggcacatggtccgctaccgctaccaacagcttgtcaacaatgcccaaggtccacaccaatgccgcccttcatttgttgcaatggcccatgattcgggatctcgtctcacgaccttacgacccacaaattctcctccaactcgaaatggccagggagccactccactcgctcacaaagaccccttgtgtggacctctccaacacttccgcctacatcgaagcctatttcgatcgtgtcaacgtttggtacgcctgtgtcaacccttatacatggaggagccactatcgtatcgccctctcgaacggtttcagggaaggaccagaaagttgtattgtgcttctcgtcttggctctcggtcaggcaagtttacgggggagcatatccaggatcgtgccacatgaggatcccccgggcctccaatatttcacggccgcatgggccttgctaccgggcatgatgacctccaacagcgttctcgccgctcaatgccaccttttagctgccgcttacctattctacctcgtccgacccctggaagcatggaaccttctctgcacaacaagtaccaagttgcagctcctccttatgacgccgaaccgagtgcctgtcgaccaaagggaactgagtgaaaggatctactggaatgctctgctgttcgagagcgacctcctcgccgagctggaccttccgcattctggtgttgttgcatttgaagaaaatgttggtctgccatgtggcttcgagggggatgagcaagaggcagttggtcgcgatgatttgtggtatttcctcgccgaaatagcacttcggcgactactcaaccgcgtcagccagctcatttactccaaggactccttggcctctacaacgagtctcgaacccatcgtgaccgagttggatttccaactaacgcagtggtacgagagtctacctctaccgctgcaatttccgtttactcggacaatgctcccagatcctgtccagacggtgttgcggttgcgcttctttgcttgccggaccattatttaccggccatacattctcgcggtcctcgacaatgaacaggcaatactggacccctcagtgcgtgacgcgtgcacaaagtgtctggaggcttcaatcagacaattggagcatatcagtgcacatattctggtgagcttggtctcacaccgcgacgttatcgaccagatcatcaacgatgtcgtcatggagatcgagcgttattccgtactctcacccagtctgagcctctcggcggagattatcaaggaagcggaggttaggcgacgaacgttcctgagtggttgaggaatcgctttactacactcgatgtcatagacacaaaaggtcaaacggtcccatcaaactcgccacatccaaacctttcaatcacccaaaagttaaaccgccagcagttgaacctatggtgttctgtcatggcacgaagcaagctacaggtgcatctggtcctccacggatgcaacgccagtacaagatgtatttttttcaggactg

SEQ ID NO: 122 - DNA, 1917 bp, Aspergillus oryzae
atgtctccttctccccaaagagacagagatactcacgttgaagcagtcgccgctgtgactgcttctgacgacttccagtcgagtaagaaaaagcgatccaattctgatgtggtcgaatatccccgaaggcgcgccacaatagcttgtcagatatgccgcctgcggaaaacaaaatgcaacggggcgcgcccaaagtgccagctctgtactgatctagacaccgaatgcgtctatagagagcctggcatcaaactcgatgccggtgataaactgatcattgaaaggcttaatcgtatcgagggactcttgcaatcaagtctagcaagccaggcagcacattgttcattaccctctacgtcaccggcaaccagtaatgataccaacatcggcggtgaagatacaccggttaagacatccagcgtggctgtcatgtctgggaaaacgtcagttgttggactcgcctcttgggctaacccacccacgagtatctcaacgatgccaaaggtacataccactcctgcgttacatctgctacagtggcctttgattcgggggttggtggccggcccctatgaccctcatacactattgcaactggaaatggctcgtgagccccttaggatgaaagcccctaaggagttggacttaacaaatgcaacgatctatatcaggaatttttttcgacgtgtcaatgtttggtacgcctgcgttaatccatatacatggtctcgatattacaaaaccgccgtgtcactcagctttcgtgaaggatctgagagctgcctggtcctcttggtcttggctcttgggtgtgctagtcactatggcagcatttcctctgtctcgccagacaaggaggccccaggcctaccctactttgcggcagcttgggaccttctccctatagttatgatgcgcaactctgtgcctgctgcacagtgtatcatactggcatcagcctatttattctacctagtcagacctctagaggcctggacccttctgtcaaatgccagcttaaaattacagctccttttcggcaatccatctcgtgttcctcttcagtggaaggaactaagtgtgcgaatatactggaacgctctgctctacgaaagcgacttgctagcggaactagatctaccacattcgggaatcgtccactttgaagagctagttgatctacctggggggtttgaggaggaggatgacgaagagtaccaagaggctgaggatgcacatggtgaaattgcatctgaaactgagcctgttggtcacgatgaattatggtacttcctagcagaaattgcattgaggagattgcttaaccgtgtcagtcacatggtttatcaaaaggatagcccattaactcttggaacacttggacctattgtttccgagctggactatcaactctctcagtggtatgagagtctgccccaacctgttcagttccctctctctcgtacacctgtgtcaaactctgtccagactgccctacgacttcgatattttgcatgcaggacaattatctaccgaccttatatgttggctgtttttgaaaatgagcagacatctttagacccagtggtaaaggagtgctgccggcggtgcatagaagccacaatacaccaactggagaatataacaagccaccgcgaaggtcatctaccatatctttggcagggagccttgtccatggtgtcacaaacgctactgatcatgggggctactatgtctccaacgctttctgccttgctgccccctgcagaccaagtagatcggatgatatcagaagtagtggcagaggtcgagagatacgcccaccttgccccgagtttaaagctatcagcagaaatcattcgggatgcagaaaaaagacgtcaaatctgtttgaggtctacagggcgttgcacttaa

SEQ ID NO: 123 - DNA, 1956 bp, Aspergillus niger
atgtcttgtcaggaacttgacagtgatactattctcgattcaacctcagcaaaaaagcgcaacaattctgaagcaaccgagtatccccgaaggcgcgcaactatagcgtaccacccggtgccgtcacatttcctatcccctggtactagctctgctacgaaaacaagtaatactaatgtgcgtgcgctgctacagtgccagatctgtcgtctacggaaaacgagatgtaacggagcccgcccaagatgccagctctgcgtagacctggatgcagattgtgtctatcgtgagccgggcatcaaactagatgccggtgacaaactgattatcgaaaagctgaacagaatagaagtcttacttcagtcgaagtttgcagaccccatcggccagtctcccctgtcatcgaattcttccacggctgccaaccttgtccaaattagtagcgatgatgctgtcagtctcgccaacatacctaccaggacaatcgcggtgggtcttggatcatgggcaaatccaccgacaagcatctcaactatgcccagagtacatacgacaccggctttgcaccttctacaatggcctctcattcgagaactggtcgctgttccttatgatcctcatacacttctacagctagaaatggctcgtgagccacttcggctcgaacctcctgtgagcttagatttatcaaacgcacttactcacgctcgactttttttcgagcgcgtaaatgtttggtacgcttgtgtcaacccattgacgtggcctcgctattacaagatggctctttctcgggacttcgagagagggcctgaaagctgcgttgtactcttggttttggcactgggcagtgccagtcaatatggaagtatatcttgcctttccgcagatgaggaacttccaggactatcatatttctccgcagcttggacccttttgccggctgttatgacgcgcaattcggtgcttgcagcgcaatgtgtcatcttggcatctgcatatttattttacatggtcaggccccttgaggcctggacgctactatcaaatgccagcatgaaattacaattactcttaggtaacccctctcgtgttccggggcaatggaaggagctgagtacaagagtgtactggaacaccttactatttgaaagtgatttgcttgccgaattagacctaccacactcggggattgtgcattttgaagagctcgtcgatctccctgggggctttgaaccggaagatgaagaagatgaagaagacgaaggaagcatacgaattgaagagaaactagtagatgcgatgataggtcaggatgagctctggtatttcttggctgaaattgccctaagaaggctgctcaacagagtcagtcatatgatctaccaaaaagacagcatcttgacactcgcatctctcggtcctatcgcctcagagctagatttccagctgtctcaatggtatgaaagccttcctcagcctgtccggtttcctctatctgggggcccaactttaagccccattcaaacagttttaaggcttcgctactttgcctgccgtacaataatatatcggccttacatcctggcggtcttccagaatgagtatgcatgcagtgacccgacagtaaaagactgctgcctgcggtgcttggacgcgacattgaatcaactcgagcatatagacagacatcgtgaaggtcacctgccgtacctctggcaaggtgccctttccatggtctctcaggcgttgttaatcatgggggcaaccatgtcaccgactctctcatcgctgttgcctccagcgactcagctagacggtatcatatctggcgtcataacggaggttggcagatatgcgcggcttgcaccaagtctaaagttatctgccgagatcattcgtgatgcggaaaagagacgccaggtgtccctcgcgtcagcggccagacgaggttga

SEQ ID NO: 124 - DNA, 2133 bp, Leptosphaeria maculans
atggccgggatcacgccctctccagacgttagtcccgtgtcagcagcaaccaccaatggccaattcccgcgggactcgttctgcctcaacctttccaccttgccggacgcaagcagttttcttctcaagtctgctcttcggtcgcctcatcttctcgagtctccgaatggactcttctcaggttgcggtggtcttagcaatccgttcagaaaacggccccgtaatatgtcgcagtcttctggcacagaccgggagatgtcaagtgacactccacctgcacagacaaatggaatagcaccaacaagcaacggtgccaatgggaccgactcgcggccatcgtcaaagaagcgacctagcaccgatactatagattacccaaggcgacgcgcaaccattgcgtgtgagatatgtcggtccaggaaatcacgatgtgatggcaccaggccaaagtgcaggctttgcaccgaattgaatgcagaatgcatttaccgagaacctggaatcaaactggacgccggcgacaaattgatcttggagcacctcaaccgcatcgagggcctgcttcagacagggctcaccagtggcttctcgctgtcttcacattcaccgactgccagtaattccacgagtgaagactttcttggccgcagcaccggaaccatgtcccatctgggcatggtccaaccgataaacggcatcgggacatggacgaaccatccgttgaacatttcgaccatgcccaaaacgcacaacactgcagccttgaatctcctctcctcgcccatgatccgagaacttgtatcccgccagtacgatgccaaaatcctcctgcaacttgagatgagtcgggactctgtcagtcttggtacaagtcgtgggttggatctatcaaacaccggcgcatacgtccaggcctactttgagagagtcaatgtattctacgcctgcgtcaatccatatacgtggagtagccactatcagactgcactcagccatggatttagagacggtcctgagagctgcatcgtgctacttgtgctcgctctgggccatgctggcagcactggaagtataacgcaacaggaccctacaaaggaccccccgggcatggcatactttgcggcagcttggaatctgcttccaacggtcatgacgaggaataacatggtcgctgcgcagtgccagatcctagctgcagcctaccttgtgtatcttgtgcgcccagtcgaagcctggaacgtgttgtcaggtgccagtatgaaactgcagttgctattgagtgctcccggaagaatctcaccagcagaggaagagttgggcaagagagtctattggaacgcagtgatgatcgagagtgatctcctggcagaattggatcttccgcactctggcattgcgcaatttgaagaaggcttctcgttacccactgggttcgaagatttgggaacggaagctgtcggcagggatgagctatggtatttccttgcggagattgctttacgccgactgctcaaccgcgtcagctcaatgttgtacatacggacaacgccttactcaaagggacctgcagccacttccatcgcccagctagatcccctggttattgaactggacttccaactgaaccaatggtatgcagggctaccgcgagccatgcagtttccgcttgacagagtaccactgcaaaaccctgtgcagacagtacttcgattgcgctacttcgcctgtcggacgatcattttccgtccatatgtacttctcgttctccaagatgagagtttagccatggattcgagcgtccaagacaattgtcacaagtgccttgaagcctgtgtgcgccagctggaatacatcacagctcatcacgccggacaccttccgtacttgttccaaggcgcactatctatcatttcacaaaccctactgatcatgggcgcgacaatgactccttcgctttcacaattacttcccccgccagccaccatggacgatataatcaacaatgttgtcctcgagatggagcgttatgctcatcttgcacctagtctacgcctgtccgccgaaatcatccgcgaggctgaagggaaacgccaattatggttgcgaactgctggtctcaagttcgaagtgtga

SEQ ID NO: 125 - DNA, 2079 bp, Glomerella graminicola
atgtccccgtcgtcgacgggtgactccccctgctcggccacgggcaacgctgggaggccctttcatgtaccgtcgcgcgagactttcaacattgaggtgccctcgccttcaatgaccaacggcatacaccctttgaagtcgcctacatcgctcaagacacaaagaacgccaagtttcagcagagatgggattctcggctcggcacaaaaggcgcggaatatgtctcactcgtccgagaaccgcccagaggctctggccaatggcatggacaaggcgcccagcgacgaaggttccaacccgctcaagaggcggaacacggacgccggcatcgactacccccggaggagggctacaatcgcgtgcgaagtgtgccggtcccgcaagtcccgctgcgatggaaccaagcccaagtgtaagctctgcaccgagctgggcgccgagtgtgtctacagagagcctggcatcaagctcgacgccggtgacaagttgatcctggagcgtctgaaccgcattgaaagcctgctgcagatgaacatggttgcagggcagggcaacggcatcgccatcaaccaagagtcgccctccatgagcaatggatcggggctcaacggagagagcataatgggagtctcgggttccgggaacatcgtctccgtcatccccaacggcggcctgggcacttggaataacccgaccaacatctcgaccatgcccaagatgcacaccaacgccgctctccacttactgcagtggccactcatccgcgatctcgtctcccgaccttatgatccgcaggtcctgctccagctcgaaatggcgcgcgagcctctgcactcgctcacaaagacaccgtgcgttgacctatcaaacacgaccgcctacatcgaagcctacttcgagcgggtgaacgtatggtacgcctgcgtcaacccctacacctggagaagccattatcgaacggctctctccaacgggttccgcgagggcgcagaaagctgcatcgtcctgctggtcctggccctgggccaagcgagtttgagaggcagcatctcgaggatcgtccccggggaagatgcgcccggcttgcagtacttcaccgccgcatgggcgcttttgccaggcatgatgacgtccaacaacgttctggcggcccagtgtcacttgctggcttcggcctatctgttctatctcgtgcggccgctcgaggcctggaacctcctctgcactacgagcacgaagttgcagctcctactcatgtcaccgaatagggtcccgccaaaccaacgagagctgacggagcggatctactggaactcgctgctgtttgagagcgacctgctggccgagctggatttgccacactcgggcgttgtccagttcgaagagaacgtcggcctgcctggcgggttcgagggtgaggaacaggaagcgattggccgtgacgatctctggtacttcttggctgagattgccttgcggcggcttctcaacagagtcagccagctgatctactcgaaagactcaatggcttccaccaccagcctggagcctgtggtggcggaactcgactttcagctgacgcaatggtatgagagcctgcccatgccgctgcagtttcccttcacccgcaacctgctctccgacccggtgcagacggtgctgcgcctgcggttctttgcttgccgcacaatcatctaccgcccgtacatcttggccgtattggacaacgaacaggcagtcctggaccctgcggtgcgcgacagttgccacaagtgcctggaagcctccatccggcaattagagcacatttctcaacatcatgccggccacatgccctatctgtggcaaggggccctctccatcgtgtcgcagacgctactagtcatgggtgcaaccatgtctccttctctcagcagcatcctcctcacactcgtacctcatcgggaaactatcgaccagattatcaatgacgtggtgatggagattgagcgatattcgaccctggcccctagcctgagcctagcagcagagattatcaaagaggccgaagtgagaaggagggcatacctgagcggatga

SEQ ID NO: 126 - DNA, 2091 bp, Grosmannia clavigera
atgccgacgagcaactcgccaacggtggccacagcagtcacagcggcgactgctcgacattcgtctgccatggacgcttctgacggcggcctatccgtcgacgccggctcaccccagcgctccgtgggcctcggccgtgacggcatcctgtcggcaccatcgtcagacggctcggacgtgaactcgcccagccttgctggcacaatcggagcggcaccaccgtcggccagcagccaggccggtctggtcacggatgccaatccgctgaagcgccgcaatgccgatgcgagcgcagactatccgcggcggcgagccatgattgcctgcgaagtttgccgctcgcgcaagtctcgctgcgacggcaccaaacccaagtgcaagctgtgcaccgagctgggtgcgacatgtatctaccgcgagcccggcatcaagctggatgccggcgacaagatgatcctcgagcggctcggccacattgagaatctactgcagatgaacctggcagatgcaataagctcgtcttccacgcagcagcagcagcagtcaccccgacgggaatcttctgccctcagcacattatggccgtccatagcagcagaaacgagtccgttcgtctcggtagtcccagccagcacaatcgggacgtggagcagcacgaccaacatatcgacgatgcccaaggtgcacaccaacgcggccatgcatctgctgcagtggccgctgatctgcgacttggtgacgcagccatatgacccgcagatcctgctgcggctggagatggcccgcgagtcgcttccatcattggcccagacgccacggatcgacctgtccaacatggccgcctacatcacggcctactttgagcgcgtcaacgtatggtatgcctgcgtgaatccgtacacgtggcacaacctctacggcacggccctggcgaacggacttcgcgagggccccgagagctgcatcgtgctgctcgtcttggccctgggtcaggccggcctaggcggcagcatctcgcgccttgtgccgcgctgcgacccacccggactgtcctacttcaccgcggcctgggcactgctgccggccatgatgacgtccaacagcgtgctggccgcacagtgccacctgctggcggccgtctacttgttctacctggtgcggccgctggaggcgtggaacctgctgtgcaccaccagcacgaagctgcagctgctgctgatggtcccggaccgcgtgccgtcaggccagcgcgagctgaccgagcggatctactggaacgccctgctgtttgagagcgacctgctggctgagctggacctgccgcactcgggcatcgtgcagctggaagagaacgtcggccttccgtgcgggttcgagggtcgagaccctacagacagccagcaagcgacgaccctcgacagcacggctgccggacgcgacgacctgtggtattttctggccgagatcgcgctccggcgtctgctcaatcgggtcagccagttgctatatgcacgggacgcagcggcgtcgccggccagcctgggcccgatcgtggccgagctagactaccagctgacgcagtggtacgacaacctgccagcaccgctgcagttctcgtttgcgagcgtgccgctggccgaccgggtgcagacggtgctgcgccagcgctttttcgcctgtcgcaccatcatctaccggccgtacatcctggcggtgctggaccgcgagcagggccgcgagcaggccgtgatgttggagccggccgtgcgtgcggcctgtcaccactgtctcgaatcggccgtgcgccagctcgagaacgtgacggccaaccaggatggccacatgccgtatctctggcaggccgcgctctccttcacgtcgcaggccctgttggtcatgggcgcgtccatgtcgccgtcgctggccgacatcctgctgtccattgtgccgagccgcgcgatgctcgatcagctcatggccaatgtcgtcgccgagacggcccgctacgccatcctggcgcccagcctcagcctggccgccgacattgtgcgccaggcagaggcccggcgacgagaatacctaggtggttga

SEQ ID NO: 127 - DNA, 1524 bp, Metarhizium acridum
atgagtgcgagccgagacaaagcctacaacccaatggcgaggtcacgccttctatctcagttctcagataaggcgcctgccactcctctccagctggcgaatagcgatggattattgtcttcgctaagaggaaatgaagtgattctactgttgattatcctcggcgcagagcagctattgcttctttttgtcatagatgcttatatgggtttcctttggcggcagtgtgaagtctgccggtccagaaagtcacgttgcgacggcagtaaaccgaaatgcaaactgtgcgccgaattgggcgccgagtgcgtctatcgcgagcctggtgtcaagctggacgctggtgacaagctgattctcgaacaactcaatcgtactgagaatttactgcaaataaacttggtcacgaaccaggccagtggcctccacctgtcacaaagttcaccatcagttagtaacgggactgccagtggcggcgaccaagcccttctgtcaaactcctcaaataccgcctctaccattcccaatggcggtctgggcacatggggtagaaacggctttgtcgaacggctttcgggaaggccccgagagttgtatcgcgctactagtgctagcacttggcaacgcaagcctccgaggaacatgataacgaccaagaatgtcctcgcggcgcaatgtcatttgcttgcggcggcgtatctattttacctggttcggcctctggaggcttggaacttgctttgcacgacgagcaccaagccgcaacttcccctaatggcccctcacaggatttcacaacggcagcgggaactggtggaaagaacatactggaacacgcttttacttgagagcgatgtacttgcagaactggatttaccgcatttcggaatagtgcagttcgagaagaacgttggactgccaggcggttttgagggcgaggagcagggacaggaacagattgggcatgatgatctatggtacttcctcgccgagattgctttgcgaagactccttaaccgagcgaaccagctcatatattccaaagattctgtggcatcaacgacaagtccggaacccgttgtggcagagctggactaccaattaacccagtggtatgaaggcctgccgccttcactgcagtttcctttctctcgcacaatgttgcatgacccgatccaagcggtcctgcgtttacgcttctatgcttgtaaaactattatctatcgcccttatattttggctgtactggaaaacgagcaagcggtcttagacccggcggttcggggttgttgccacaagtgcttggaagcatcagtgcggcagttggaacacattatggagcatcacgctggacagatgtcctatatatggcaagcattggacgaccttatcagtgaagttatcacgggggtgcagaattatgcatccctggcaccaagtttgaggctggcagtcagtatggcccgggtacgggagccacggtttgtgttgtcacaacgccgggccattagccccggacaataa

SEQ ID NO: 128 - DNA, 2049 bp, Metarhizium anisopliae
atgaacacgtctcccgatggtctcaaggtgaaccagaccttgggtgcgggccgagacaaagcccacaacccaatgtcgaggtcacgcctactatttcagcccccagacacggcgcctgctactcctctccagctggcgaatagcgatggattattgtcttcgcttaagaggaaattaagcgattgtaccgtcgattatcctcggcgcagagcaactattgctgtgagtaaacagtctctatgcacgtctgcccgttttgtgtcacaaatgcttactccgtatgtggatttccattgccggcagtgtgaagtctgccggtctagaaagtctcgctgcgacggcagtaaaccaaaatgcaaattatgcgccgaattgggcgccgagtgcgtttatcgcgagcctggtgtcaagttggacgctggtgacaagttgattctcgaacaactcaatcgtattgaaaatttactgcaaatcaacctggccgcgaaccagggcagcggcctccatatgtcacaaagttcatcatcaaccagtaatgggactgccagtggcggcgaccaagcccttctgtcaaactcttcaaatacggcccctaccattcccaatggcggtctgggcacatgggttagtgtccctactggaacaaacatctcaacaatgccaagatgccatacaaacgcaaccatgcacctgcttcaatggcctctcatccgtgacctcgtctctactccgtacgaccctcaaatcctgttgcaactagagatggatcgagaacctctacacacgctaacaaaaacaccatgtgttgacctttcaaacacacaagcatacattcaagcatattttgatagagtcaatatatggtatgcttgtgtcaatccttatacatggcgaagtcaatacagaacggctttgtcgaatggctttcgggaaggccccgagagttgtatcgtgttactggtgctagcacttggcgatgcaagcctccgaggaagtatatcccgtattgtgccgcatcaagagccgccggggttgcaatacttcactgctgcctggtcgctgcttcctggtatgataacgacgaacaatgtcctcgcggcacaatgccatctgcttgctgcggcgtatctattttacctggttcggccccttgaggcttggaacttactttgcacggcgagcaccaagctgcaacttctcctaatggcccctaacagaattccacagaagcagcgagaactggtggaaagaatatactggaatacgcttttgtttgagagcgatttacttgcagaactggatttgccgcactctggagttgtgcagttcgaggagaacgttggactgccaggcggtttcgagggcgaggagcagggacaggcacgaattggccatgatgatctatggtacttcctcgccgagattgctttgcgaagactccttaaccgagcgagccagctcatatattccaaagattctgtgtcatcgacaactagtctggaacccgttgtggcagagctggactaccaattaactcagtggtatgaaggcctgccgcctcccttgcagtttcctttctctcgcacaatgctacatgacccgatccaagcggtcctgcgtttacgcttctatgcttgtaaaactattatctatcgcccctatattttggccgtactggaaaacgagcaagcggtcttggacccggcggttcgcgaatgttgccacaagtgcctggaagcatcagtgcggcagttggagcacgttacggagcatcacgctgggcatatgccctatatatggcaagggactttgtctatgatggcccagacgcttctattaatgggctcatccatgtcgccgtcattgatgggcatacttctcacgattgtacctcatcagaaagcattggacgaccttatcaatgaagttatcatggaggtgcagaattatgcatccctggcaccaagtttgcggctggcggtcgaaattattaaagaggccgagctgtcgaatattacgaacgaagctcgcctgttacggctcgcttga

SEQ ID NO: 129 - DNA, 2034 bp, Neurospora tetrasperma
atgtcgccgtcttccaacagcgactctcccgcttcggtagtgggcagcatgaccatggccgcgcaggctgctcccaacgctgtaaggcaataccctctgccgaatcgggacttcacaatcgaaataccttcgccccaaattgcacccactaccaatggggtcaacaccgtcaagtcaccctccactctcaagtctgcccgtgctcccaacttcagccgggaaggtattcttggatcggcccagaaagcccgaaatctctcgcagtcgtccgaaaaccggcctgacaatgtcaatgtctctaatggctttcaaaaggctcctagtgaagagagcaccaatccgctgaaaagaagaaatacggatgctggtgtcgactaccctagaagaagggcaaccattgcgtgcgaggtatgccgctcgaggaagtcgcggtgtgacggcacaaaaccaaaatgcaagctgtgcacagagttgggtgccgagtgcatatatcgcgagcccggtatcaagctggatgccggcgacaagctcatcctcgaacgcctcaacaggatagaaagtctgctgcaattaaacatgggcctaaccggtcataccaatggcctaggattatcccataactccccggggatgagcaacgggacagggttgagtggtgacaacctgatgatgcaaaatcccgatgccgccggctttgtctcggtgatccccagcggaggcttgggcacatggtctgccaccgctaccaacagcttgtcaacaatgcccaaggtccacaccaatgccgcccttcatttgttgcaatggcccatgatccgggatctcgtctcacgaccttacgacccacaaattctcctccaactcgaaatggccagggagccactccactcgctcacaaagaccccttgtgtggacctctccaacacttccgcctacatcgaagcctattttgatcgtgtcaacgtttggtacgcctgtgtcaacccttatacatggaggagccactatcgtatcgccctctcgaacggtttcagggaaggaccagaaagttgtattgtgcttctcgtcttggctctcggtcaggcaagtttacgggggagcatatccaggatcgtgccacatgaggatcccccgggcctccaatatttcacggccgcatgggccttgctaccgggcatgatgacctccaacagcgttctcgccgcgcaatgccaccttttagctgccgcttacctattctacctcgtccgacccctggaagcatggaaccttctctgcacaacaagtaccaagttgcagctcctccttatgacgccgaaccgggtgcctgtcgaccaaagggaactgagtgaaaggatctactggaatgctctgctgttcgagagcgacctcctcgccgagctggaccttccgcattctggtgttgttgcatttgaagaaaatgttggtctgccatgtggcttcgagggggatgagcaagaggcagttggtcgcgatgatttgtggtatttcctcgccgagatagcacttcggcgactactcaaccgcgtcagccagctcatttactccaaggactccttggcctctacaacgagtctcgaacccatcgtgaccgagttggatttccaactaacgcagtggtacgagagtctacctctaccgctgcaattcccgtttactcggacaatgctcccagatcctgtccagacggtgttgcggttgcgcttctttgcttgccggaccattatttaccggccatacattctcgcagtcctcgacaatgaacaggcaatactggacccctcagtgcgtgacgcgtgcacaaagtgtctggaggcttcaatcagacaattggagcatatcagtgcacatattctggtcagcttggtctcacaccgcgacgttatcgaccagatcatcaacgatgtcgtcatggaaatcgagcgttattccgtactctcacccagtctgagcctctcggcggagattatcaaggaagcggaggttaggcgacgaacgtttctgagtggttga

SEQ ID NO: 130 - DNA, 1809 bp, Mycosphaerella graminicola
atggaccaagacctcgcattcgatgaaattccggactacccacgacgacgagcgatgatagcttgcgagatatgtcgaagccgcaagtccaaatgcgatggatcccggccgaaatgcaagctttgcatcgatctcaacgctgcatgcgtgtatcgcgaaccgggcgtgaaactggatgcaggcgacaaaatcattctggacaggcttgcgaacatcgaagcattgatccagtcgaagtttcctactctatctcaagctgatagctcgacagcgggaccgctagctctacctgccgagcaagggagaactgtcggaaatggccctggatcaatacctcttagcggctttggtatatcgcaggcggcgatgaacatctccaccatgcccaaagctcacaccacgccggctctacatctccttcagtggccgtgcatctgcgacctcgttacaagtccctgcgatccgcaagtccttcttcagctcgaaatgactcgaccaccactcgaccttcgatcccactaccctctcgatctgtccgatctctgctcctccatctatacccgagccttttttggaaaggtcaatgtatggtatgccgtcgtcaatcctcacagctggaacgaactctatcgtacggcttccttgaacagctttcgatccggacccgaaagctgcgtcgttctcctcgttttcgcgctcggccaagcggctcatacagataccagtactgctcatgcctcatatgacggacgtccacctggtactgcctacttcgaagccgcctggcagttgcttcccaccctcatgctccgcaacaacgtgatgagtgcgcaatgccacattcttgcagccgcttatctcctctatctagtgagaccactagaagcatggaacctcctctgctcggtctcgataaaattgcagctcctcctctcctcatcatcacctctgccatccgctgaagcccgaaatttgctcgaacgcatctactggaacactctcatgttcgagtccgacctcctcgctgagctcgatctcccacactccggtatcgtgcagttcgaagagtccatgcctctgcctcgtagctttccgttgactccaatttcgccatctccatcatcctccgctcccgcgccctctcccggcagcgatgaaatctggtacttcctcgccgagatcgcgcttcgacgtctcctcaaccgtgtctcccacttgctctattcgaagtcactttcgctggcctctctcgctcctctagtcaccgaattagaccttcagctgactcagtggcacaaccacctgccaccttcggtacagttcccgatccgtccatcttcttccttgcccgatgaagctctcgaccccgtccaaaccgtccttcgactaaggtatcacgcctgtagaaccatcatccacaggccgtacattctctacgtactgtcttccgctacgccgactgtgggcaattccacttcacacatctctgaagcatgcgccacgggactagaatcagcttacattcaaatatcgctgctgtcctcgcatcgtgctggacatgtgccgtatctctaccaaggttttctgtcgctcgtgtcacagacgttgctgttgcttggagcctcgctgcatacagagctgaggcgactgatgccggtccgaaaagaagcgctggtgaagacggtggacagcgttagaattgaattgaatactttgggacgactggcgccgagtctggaggtcagtggaggaatattgggagatgcggtggacagatggaaggagagaatttcgggcgtcgaatggtga

SEQ ID NO: 131 - DNA, 1845 bp, Trichoderma reesei
cgcccggcagcccgcggcaccgccttctatccgaggaaacgggccaacaccgcctgccaggtctgcagagcccgcaagacaaagtgcgataacaagaagcccgcctgtagttactgcgtcagcgtcggcgccacgtgcattcagtccccggtggatctgtccagcttcgaccccgccagcctgaagatcctcgatcgcattgacgagctggagcgtctgctgcggcatgccgtccccatacccggccccgaggctgccgcgccgccatcgtcggctctcgctccggctccgaccacaggcttctccaaccaccagcggctgcccccactctcgcgatccaggacctttgacggcatcggtggtgcaatgcacgcccctagctcaagtgtcagcagtgtgtcgggtcgcaggcacccggacgacaatatggacatcagccttctgcctcagcgggtagaccacatcctgcagtggccggtcttccagaactccggcagccaccaccactcgccggcctcgtaccgcgcccctcccgatgccatctcgacccctccctccggctcggcatcgctggcgggccttattgatatggattcccaccgcatatacagattactagacaacttctttctgcacattcactgcaagaacccaatcctcgacgaagtcttggcacgccgcatggtaatcaacgcttttctggacggcattgactggtctcccgcctcgtgcctggcgctcatcatatgcgctctcggctgcatcgccacgccctttggccccagcggcgagaccaagctgggcacgcagacctacaacgactctcagatcttctttcaggccgcccagaagcgcatcggcattctgctcgtgcgctccgatattgtcggcgcccagtgtctgtttctatcaggcgtctatctgatgatggtcttccaacccgtctacgcatggcgcttcttctctcaggccctggcagcttgccaacactttcccttcctggctcgggcccagaacctcaacgcctcgctcgactcgatggaaatgggccgccaagatacccaagaacaggccgtgtactggtctgcgtggaagtcggaacgagagctacgacaggagctagaccttcctgatttcgacatcctccattccgggagcaccttgtatccgccctttttccccgcgcctccaattgccccggccgagtctccggacgggccagactccgagacacagcgggctcgcgccgcctggctgttctacctcgccgagatctcgctccgccgtctcaccagccgcctttccagagaagccttagatctccgccagcgctattcctctgactcggtactgctcgacatgctgctggatatgatgcccgagtacgaggctcagatccgcgagtggtcggagagcctgcccgctgacctctccatccatactcccgtggaagaggacggcatatgccggtcggtcctccgaggcaggatgattaatctcttggagcagatttactggccttttgtcatggccagcattagcgctcatgccacaaggcgtcccgtcaagccagctgtggcagagtttgccaaacggggcctggagacacacatgcatcaggtacacgtcaacaagcctggtttccatcatcgacatcatgggagcatgttcatgattcgggcctgcacgcgaagcgccttggttttgctagcagccgccaaagcggggtgtgccatgcccaccgactgggaggattctgtttacaaaaccgtcggcatgctggcctactgggaggacgaggacagagacttgatacactggagatcaaccctggagcgagagctc

SEQ ID NO: 132 - DNA, 1770 bp, Neurospora crassa
atggcccaacaatttccggacaagaagttccagctttcgtataccacgacggcttcatggcttgataccagggaccgagcctggcatgatagcctgttcctatgtgacggtgatacgccatgtgcggcttgtgtcgcaactgaaaacgactgcacttatggatctgaagccaactcgagaggaaagagtgatctcatcctggaaggggtgttgcgtgttgagaagtatcttcacgagttgaatgcaaacattgcagcatcgccacacttcgttagtcgcagttcttctcatcatgtactgtcatccgcggtcggctcgtcagttggtagagggagcttctccggaggctccctaaccgacctgcgcattacacctcgccctaccctctgtccacatccggacgagctagacaacgctaacaacctggagaatgctgttcttgaatcacggcacacttctacaacggagtcgatattacaatggccccatttcgacgtctttcctagtcttcgcaaggactacacttccatcttccaccttgagcagtctcgtcctcgcatcaagacgaagaaaagagacatttatccgtatatgacagaagaagaggtcgacagcattttggatgctttcggccatgccgtcaacttctggtatcctacaacgtcaagcgatcagctacataatgctcgggcactcatcacgaacggaaactttgaagacaacgatgagctctgcgtctgccttgctttactcgtcatggcactgggttgtgcaagcaaggtgacggcaggcttgatggaaagcgctgctgtccctgagagcgaacagagacgcagagcaacttatcgtgcaacgggcgatatgtatttcgagagtgcgctcaagaagctttacgttgcccacatggatgtcagctccatagccacacagtgtcttttcttcgtagctctttacttcgccttccttcgccgtcccctccaagcatgggagtatatttccgccgcagccaccaagtgtctccttctcctttcatactcttcccaagattccacttccgaagatcaagaacgtattcgccgcatcttttggtcctgctacattctcgaatcggattacttagctgagctctccaacttgccgctatcaggtattgctcgtgttgaatcctcagttccgctaccagatgcatggtatagcacgcattcgaacgcccaagaggaggagcagagctctttgtactttttggcctgtatctcgatgaggaggctgctgaatcgagtacatcagctactgtatgctaggggaacaggcgcgagtttggatgataagcggttccctggcattgtgaaggagctggatcatcagttggatgagtggaggactgtgctgccagaagcctttgctttcgaggttgagtggccgccagtcggtgcgaagcacaatatcaccggagtaaagacggagcatggggggttcctgaggcaaaggtatctcacttgtaggagtgtcatctaccggccaatggcaggcgcaatgctcgttctcttggccgcctgccggatatctttgctcaaagacctcatcgggcccgagatccttcaagcgggaagccacttgagggaattgttggtaggatggcagaaagtgcaaggagatccgagctcgcccagcgtgaatcaaagtatacatattatcaaggaggctgagaggttcatcagacaggtctataagggtggaaaggatgaagagcaaggccgcattgaggagtaa

SEQ ID NO: 133 - DNA, 2439 bp, Neurospora crassa; identical to SEQ ID NO: 5

SEQ ID NO: 134 - DNA, 2199 bp, Aspergillus terreus
atgtttcacacttttgacggcagcgaaagcgcttcgcgggcggccccaggccgacaggggcccggcggagaacgaggtgagacgaccggccggcgagtgacgaccgcgcgggcgtgtacctcctgtcgccatcgcaagatcaagtgcgacggcgagaggccgtgtgaggcctgtcgctggtacagaaaggccgaccagtgccactatgcacacccgcggacatcagacagtaaacgggtcaaggaagtgtccgccacccttgacacataccgacgggttctgggcacgctgttccccaacgtcaacgtcgagtcgctggataacctgcctcgcgagaagctgctcgaagtcctcgccgctcagtcgcagcagtcgccgggcagtataccgcagcccagctcctcgccaacggccaccctggcatccgtagcgacacatggcgactcgaccgaggatgacaacctggagctcttgcaaaccatgcccgccgagcccctcgaccggcaacatactggctctaccgatcccgaccaaggcctctcggacgatgtcaacggcctggccttgtgtgctcgacagccctcgtcgtatctcggcatctcgtcgacccaggctgtcctgaaagtcatcgtgttgttaaacccgggctgcgcctcgtacttgtcgcgaaagcccaccagtgctggcgaggggacggcgtatggagcgccatcgggctggctgccacatgcgccggtggccccgttgcagccgcagcatctcccgctcaccgagatgcagttcctcgatgcctatttcctcatcttccatgcattctgtcccatgatcgacgagaagtccttccgcgagacgtacctcgccggccaccgccgggacaaaccctggctggccctgttgaatatcgtgctggccctgggcagcgtcgcggcgacgaacccaaacgacacgacgcatcagatctactaccagcgctgcgaggagaacctgggtctgagcgccttgggcaacccgcagatcgagatcatccagacgctgggtctgatcagcggctggtactgccactacctcagtcagcccgaactcgcccagtcgctcatgggcgccgccctgcgaatggcaaccgcccggggcctccacaaggaaccgatcaagcacgaccaggtgctggacccggcgacggcggcgtccctggatatcaagcgccgcacctggtggtcgctgttctgcatggacacctgggccggtatgactctcggtcggccgagcatgggtcggactggtttgactatcacggtcaagcctccccacggccgggacgaggaaacacttatggacgttctcccgctggtggagaacattcgctttgcgcggatcgccaccgagatccaggaactcctcgcagccgcgccgctgggcaagcaccaggccgcacagatggacgcgcagctgctggaatggtgggagaacctgccggcgattctgaaagactacgagccgtgcccggagcgcatcaagacggtccgcaacgtcatgcgctggcgctactacaaccagcgcatcctgctgtaccgccccacgctgctgagctacgcgatgcggcgcgtgtcgtacctggccctgcgcaccgaggagcgcaccgccatcgagaagtgccgcgagatggccgagctctccatccagcacatcgccgccaccgcgcagacgaaccagctcggcggctggaacgccgtctggtggaccttcctggcctcgatggtgcccctgctggggctcttcatcaacgacccgaccgccaccgacccgcgcgcctccatccgctcctgtcaggcccaggtcgagaccgccatgctcaccttcgcccgcatgcacgccctcggccataccgccaagacctccctcgacgccgtgtcgcgcatcttcgaggcgagcaagcacgtcgataacctcgccgtgcatggcgccgccctgccggttcttgccccggcggtggattccgtgcgcagggatgcgactgcgctgggggtgatgccgcagccagagatgaatagggcgatgacgagccacagcgaggcggcccacttggatgccctcatctacccgtttgtccacgatgccaatgaccagcagatgtgggactatctcagctggggggataatagtatgtggcctggacttgttacggatatagcgatggcatag

SEQ ID NO: 135 - DNA, 2334 bp, Aspergillus terreus
atgttccatacattcgaagggttcgaaaatccggcgggctcgaccgtctctcggggccgtaatgaacgccagcagtcagtcggtcggcgagtcaccaccttgagagcctgcacttcttgccgacatcgcaagatcaagtgcgatggtgagaaaccatgtgaagcatgcagatggtacaagaaggcagaactctgtcattactcggaccctcgtccttctcgccgacatgtagaaaaattgtccaccacgttggacgaatatcgaggcgtgctggagaagctcttcccgaacatgtcgcccgaggcgctattcaacctaccccgtgagaagttgctggagatgaccaccacaggcgcaacagcccatggccaagtccagggagcgcatccagcttcgcctgccacctccgcctcggtagaggctcatgtctcgcccatgtccaacgaggatacgaatctcgagtctcttcaaaccatgccggatgagtccagtgaggccaggaactcagccaacagcgaagccaccaatggcatctccgatgatgtcaacggactgtcgctgtcggcacggcagccctcctcctatctcggagtgtcctccatcaacgcagtcctcaaggttatcgtctggctggacccgggctcagtaacctatttctcccgcactcctgccatgggcgctcgacgagggtctatcgtggacctttcagccccggaagcacagaactggccggtccaggccgggcagcagcaacagccggttactcccccgcaacaggtaccagtcacggacgtgcagatgctggatgcgtactttacatatattcaaccattcattcctatgttggacgaacagtccttccgggaaacctacatgtctggccagcggaaagatgatcaatggcttgccttgttgaacgtcgtatttgccatgggcagcatcgcggcctgtccctcggatgatacgacccaccaaacgtactaccaacgcgctaagggctatttgaatctggagtgtcttggctcgtcgcatctggagacgattcaggcgttgggtctcctgggcggatattatctgcactacgtcagccagcccaatttggcgtattcgctcatgggcgcagctctccgcatggcggcggccctgggcctgcacaaggagttcaccgaaggccaggatgcaaataacaagcagaaagtgtcgtccatggacctcaaacgccgcatctggtggtctttgttttgtctcgatacttggggtggcatgacgctgggccgacccagcatgggacgcttcgggcccaccatcaccgtgaaactgccccatcatcgggagaatgggaatgtattggacatccttcccctcttggagaatgtccggttctgcaagattgcgacccagatccaagaggtcctagcggtcactcctctcaccagatatcaggacattacccacttcgacaaccagctcttggactggtatgaaaaccttccatacatcctcaaagaccatcaaccatgctcggagtcgattacgatcgcgcggacggtaatgaagtggcgatacgccaatcaacgcatgcttctctaccgcccaacgctgctgagctacgctctccggcgcgtaccatacatcgccctccgctccgaagagcgaactgcgatcgagcgatgcagagagattgcagaggaggccattcaggacatctcgtccacggcacagtcccaccagatgtcaggctggaacgccgtgtggctgattttccaggcggtgatggtccctctgctggggctgtaccttaacgacagcaccaacaacgacccgcgcgcaaccgtcgagtcgtgtcaggcgcaggtcgaaacggcgatgctcgtgctggcgcgacttcagccgtggagccccacggcgagacgcaccctcgacgccgtttcccgcatcctcgaggccagtaaacgcggccccgaccccatgatcaacgacgccggcaatatgcccaatggcaatccatgtcccacctcggtgcctggggcggcacccagcatcctcctctcccagcatgagcttcctcgcggaatgaacctggacagcgggttcgcagattccatggcgccggcctttatggacgattctgctggccagcatctgtgggacttcctcagctggagcgacaacagcctgtggcctggagtgacggagctggacggcaccgtggaggatattttgatgatgcccgacgacaagggcgcgaaatttggcaacgggccctcggcgttcttcggcaacccgatgggcgagccaacctactatgccaacacggcgctgccgttttattag

SEQ ID NO: 136 - DNA, 1896 bp, Aspergillus terreus
atggaggtagcccgtgcacaagttttgcatggtgctgcttcatacagtgccttaaacaaagctaccgagacagtccgtcggcaggcggcggttcttcaagtgctgtttcctcacgtcactttggatgatctggtggacaaggaccgagctgagctcatccgtcttctatcgcaatcttcctcaacaaacgcagatctaccagcagaaagattcgtcgtggcgtcatccgtgtccgacagcccagaaaacgatcccagtgcattggaggagtcagatgaagcagatgattcggaggaccggcattgggacgagtcagcaaaagaccctgcaactctggcaaccagcgacgatatcaacgccattgggctggcgggcgaccgacgccgccggtcatatctggggatttgctcggtaggtgcggttctcaaagcattattccggctttgtccaggcgcaaaagagtgcatcatagaagactccaagctctgggcccccgtccaaccggacgacactcgccctgcactcctaccccaaggccttgccatgactccattattggactcactgagagaattgcgctatatcacattctactttgacaacgttcacgcaatcacgcctttcttgcatgaggagtcgttcagagcaaaattcacgattagagatcaacaaggctcctcatggttgggtctctgcaacatggtcctcacggtgggatccatcgcttctggcagtgatacagctcacatccactactataaccaggctcgctcgtacctcgatctagattcattgggttctggtaacttggagacgttacaggcgctgtgcttacttggcgggtactatctgcattaccgaaactccccaaacatggcatattcaatcctgggcgccgctcagcgcttggccatagcgttgggcttacaccgagagccgcccactcgaaacgaacagcctaaccctgagacacgcggatcctatgcgcttcggctcgagactcggcgtcgcacttggtggagtctttactgtctcgatacctgggcgagtatgacgctaggccgaccgacttgcggccgatgggatacagccactatgaatacatcgttgccctgcaccctccattcagaggaccatttcgctacgtccttaagggccagcgtcgagttctgccacatctgtaaccgtctccaacatcgcttcgcccaatttatccggatcagcgtccatgaagcccaggccttggactacgatcttcagcggtggtatgacggccttcatccagtcctgcagcatacaacagacgctccgccgcgaatgagtgtcgcgcgcgaattcctacgcaacagatactacaacgcgcgattgatcctgtcgcgctgtttcttgctctacatggcctatgaggatactaaaaggcgccatcctcactcagcggagcagcagatggcgggcatgtgtcgttccattgctggagagaccatcgatgcaatcgcactccactgggtccccaatcgcacacaggtctggaatgctgcctggtatctcttccaagcctgcatggtgccgctgctatccatagccatggctaatacgtccgatcacgctgcagttgaccctgcggacgtctcggcctggtacgccagcttgcacaaggcccttgaagccttctcagagatgaggccatggatgcgggcatcggatcgcgccccaaacatcgttgctgttctgctccgagccgtgtcgcagggacccgacggatctatacacacaccatccgtgacggatggcgcattgaatctctttgggatgtctgatgagtttctcatcgaaatggactggagcgagcttcccaatgacgagaatatgttccaaagtctgtttccattgacatga

SEQ ID NO: 137 - DNA, 2394 bp, Chaetomium globosum
atggcaccaaccatcccagtgcccacacagggcggcatgttccacaccttccaaggcgtcacaccacgcaaagcatcaacagattcccaagacagcaccaagaccagcggatcggggaccgctaagaggataaccacaccacacgcctgtgccgagtgcaagagacgcaagattagggcacccaagatgtgcttttatgacaagcaccggcagcgggtgattccctcacgcaagaccctcgaagccctctcacagtcactcgaagaatgccgctccatcctgaagcggttgtatcccaaccaggaggtccaggctttgctgcccctatcacgacaggagctgcttaacctcctggaccggcccgtaatagacacctcggtcggcggtctcccatcaccgcccatcaacacctcgcccatctcggacatcggctcgccaatgatgaccaagtcggaaaacatcctggagcagcttccgtcgagagacaccgaatgggacgaggaacggagggggagagacccaatccccgccgaggctgacgacatcaacgctctctcgctctccgtggaccggcaagcatcctacctcggcgcctcctccatcaaggctgccttgatggtcatgctcaaggtgcagcccagcttgaggaacaccctcgccgcgcctctgagcggcgtcgagatgtcacacaacttccccgccgtgaggcaaaagtcttcggccgcgccaaaagaccctcagcggattccgtggtcctggaagggccaaaccttgatcgacgcctacttcaagcgcatccacgtcttcgtccccatgcttgacgaaagcgccttccgggccgactatcttgaaggacagcgaaccgacgctccctggctggcactactcaacatggtgtttgccatgggaagcatcgctgccatgaaatccgatgactacaaccacatcaactactacaaccgcgccatggagcacttgcccatggacgcctttggcagcagccacatcgagatggttcaagccctcgccctcatcggcggctactacctacactacattaaccgccctaacatggctaacgccgtcctcggcgccgccattcgcatggccagcgctctcggcctgcaccgcgagtctctcgcccagtccagcagcgacatcatcgcggccgagactcgccggcgcacttggtggtctctcttctgcctcgacacgtgggcgaccactaccatgggtcgcccctccttcggccgctggggaccggccatcaacatccggccgcccgagtttggcatcaacgccaaccgtgactcgtcgcagcacgccggcatcctaccgctgatcgagaacatcaagttctgcaagatcgcgacccagattcaagatatgctcgccatcacaccgctcctcaacaccgaagaccgctgcaacctcgactcgcagctcgtcgcctggtacacgtcactgccctggctgctgcgcaccacagacccctgcgcggagccgctctacatggcccgctgcatcatgaagtggcgctaccagaacctacgcatgctgctgcaccgaccggtgctgctctcgctcgcctcgtcgggcttgaacccgcacacacaggcttgcgacgccgacctggccgccatcgagacgtgccgcgacctcgccgcgcagactatcgatgatatcgcgcgcgagtgggcgcggaaccagatgagcggctggaacgcggtctggtttctgtaccaagccgccatggtgccgctcgtcagcgtcttctggcagtgggggtcgccgcgcgtgcccgagtggctcaagcagatcgaggccgtcctggacctgctcgaggtcatggaggagtggtcgctagccgctcgccgatcgcgcgaggtcgtctggcgtatgtacgaggctgcccgccagctcgtcgcccagcagcgcgccagcgccagcccttccatccaggtgctcacgggcggcggcgccgctggcgctgaaggtatgctgatggccagcccgggctccgccgaagctgccggtatgcacatgagccccatcggcctcgagcccgtcgatggccttggcctcatgggcctcctcgatcagggcggcctgtggggagacctcgacggcatgtactggggcagccagcacagccattccgggagcatgagcctgggtagccccgtcgacgagtcggccatggccgccgccgccgctcacgagtttgccgctgccgcggcttaccacccgggtgcgcctactactgccggcccgcacgagggcatggtgcacgccgttgactacggcggcctcatgggccatcacgcacacccccatcacggaggccaccaccatcaccaggcggccgcaatggagtttggatacgtccaataa

SEQ ID NO: 138 - DNA, 2274 bp, Coccidioides immitis
atgttccatattttcgaaggattcgagaatcccgataaggcccggagtcaccgcgagggccgtggcaagagcggaaaaagatcctcgacggtgcgtgcctgcgaacaatgtcgacgccgcaagattcgctgcgatggagagcagccgtgcgaggcgtgccagtggtataaaaagactgatctgtgtcattactcggatcctcgcccgtccagaaggcatgtcgaaaagctatcttccaccgtcgaggagtatcgagtcgtgtttgagaaactctttccgtccatccctttgcaatctctctccaacctcccccgcgaacgccttctagagctggcctcgagaacccaaccgcagtccgaaattcttcctgttcccgtgtccaagcccccaccgtctgtcgataaccatgtcctccctctccccccagaagatgaaaacctagaatccctccagacaatgcccgatgattccaccgagagtcgtacatgccggagcccagatctcgtcgccgctgtgtccgacgatgtcaacgcgttgtccttatcaacaaaacggccctcaacatacttggggatatcttcggtgaatgctgttatgcgggtaataatgtggattgatcccgagagctcccagcatttctccagagctcccgatccgcaacccttcgcgaaacgggagaaacaacctctcccggataactgctcttggtccttgcagcccccaccttccacggctgggcatctggaagtaaatcccatggagcttaccaacgcgtactttgcatacttccactccttcgctccattgctggatgagcacttattccgcgaaactgtcctggttcgtaaaaggtccgatccgcgttggctagcactccaaaatattgtttttgcacttggaagtattgctgcatacacggccgatgatacatcccacgagtcctactatctaaaagctagacactatttgagtttggatacccttgggaatccgcatttagagaccatccagacccttgccttaatgggaggccattacttacattatatgagccaacccaaccttgcacattctcttatggcagttgctctgcgtatggccactgttctaggtctgcataaagaattcattggaaatcaggaagctgctagccaaaacagccaaagaaaattctctgtcgatttacgaagaaggatctggtggtctctcttctgccttgacacttggggctatatgacgttgggtagaccaagtatgggacggtggggccctggaattacagccaaactcccacataaccacggaaacaaggtgggagacgctcttgcagcttctccgattgtcagctatcaagaaatggtcagtctcgataatcagttggtcgaatggtatgacaatcttcctccgctcctaaaggatcatgaacccagtgcagatccggtttctacaacgcgaaccgtgatgcgatggcggtatcaaagccagcgtattcttcttcatcgtcctgtcttgctaagctacgcgatgcgtcgtatcccctatgttgcactcagaacagaagagagatatgctattgaaagatgcaggatggtcgctaatgaaacaattcgggatgtcgcttcaactactcgcttgaaccaaatgacaggatggaatgctgtttggctcctcttccaagccacactagttccgctccttgggctttttattgctgatggaaccgccacccatgcgcacgcaacgtcggatagctgcagaaaccaagttgaaacggcgattgttgcccttgagcgcttggagaactggagtccaactgccaagagaacgttggaggtagtctctcgaatcctagaaactagccagcgaccacgccacaccagcgccggcagctgtacatctggaagcgacacccacacagccggcatgagtgatcagtctgccaccgcttcatcggaaacatcaaacaccgcgccttctattcacactatggaccaaacagccgtccttagcaatgctgcgttccctagttaccagaatattgcaccatatatacagccctcaccgcagcaaatgttggattatattacatggggggataataacatctggtcgagcgtccaagaggatttttatactcaacaaccccccgctgtggggatgtttggccagggtcaacagtatcttaagcctcttgatcatgaacctcccgcggctggagaaagggttggagtgtatgataccggattagagaccccgaatattgtacggttttag

SEQ ID NO: 139 - DNA, 2106 bp, Neosartorya fischeri
atgttccacacctttgaactccgccacagcaacccgcgcacagcgactggagaacaacggcgaggaagacgaccaggattacgagcctgcaaggaatgtcgtcgacgcaagatccgctgcaccgggacgcatccttgtgagccgtgtctgtactacaaaaagccggagctgtgccgctattcggatcccagagtgccacacagcgggacgcgagaccatggttcccatcccgatagtcagtaccggtctgttttggagagattgtttccttcagtctcgttgcagtcgctcgcgtctctgacgcgcgaggagctcctggatctgttgcgagatagtatacttggctcggatcggccccctccgcagcctcctgagcgtccgggggaggagcactcacgatcgtctttggaggcgatttcaatgggaaacgctgatactggtgaagttaatgctgtcaatgacaaggatgatgtatcggatgatgtcaacgcgctctccatggcaacgcgtccgccgtccacctacctgggcatctcttccatcaatgccgtcctcaaggtgatcagctgggtcaatccggaatcaatggctcgaccgttcactacaactccatcgagaaacaggcctagagtgaaaacgcgagctcccgtaaccccatcaaccgagtcccaagcccgcgaccaactcatcgacgcctacttcaacttcatccatccctccatgccgctcctcgacgaaaccgacttccgacagacctacgtatccaacaccaggcgcgacgagcactggctcgccctcatgaacatggtcctcgccctaggcagcatctccctctaccccagcgatgacaccacgcacatcacgtactgcaagcgcgcgcgccaacacctctccctcgaatccctcggcagcgcacacatcgagaccgtccagaccctcggcatcatggccggccactacctgcactacatcagccagccaaacctggcgtacgtgctcatcggggccgcggtacggatggccaccgcgctgggtctacacaaggagaccgcagacacagacgcgagcgagagcagaccgctccagtcatcgtctgtgcccgtcgacctgcgccggcgcatctggtggtcgctctactgcctcgatacatggggttgcatgaccctcggacggccaacgctaggccgctcatcgacggccgtctcgacgaagccgccagcgaacacatcaaccaccctcatcctcctcgaaaacatccgcttttgccaaatcgccacccgcgcccaggaagccctcgccgcatcccctctcccgccctacgcccaactccaagatctcgacaccgagctgacaaactggtacgcgcagctcccaccgctcctgaaaacgtacgaaccatgcccggactcggtccatacagcccgcaccatcatgcgctggagtctgcataacctgcgcatcctcctctaccgcccgttcctgctacggtatgccctccgccgcgtccctgccatcacgctccacaccgaagagcgcctcgcgattgagaagtgccaggtcctcgcgcgccaggcgatacgcgatattgctgagacgcaggtgaagagccccccggctgcgtggggggttatctggcatgggttccaggcgagcctggtgccgctgctgatgttgagtattcttgccgcggaggctgaaaacgatgtggacatagagatggtggagtcgtgcagggagcagcttgaggtcgccatggctgctattgcgcgcgtcgaggcgtggcagccgactgcgcggccgagtctggatcttattgcggggatttttcgggcgtcgttggcgaggttggggttgatggcagcgtcgggggcctcatcggatgggacgtctcctgttgccccggggcgggtatatccggttgatttgcagcccagggtccaggtcccgcagaccgttccgatggcgtatacggggaatgagctgggcgtgtcgagtcaggatgtttgggattatattagttgggtgagtcccacggcgtggactgatgtgcaggggcaggcgagtacgatggatctgtggtccacgccggggtggtggcagctttga

SEQ ID NO: 140 - DNA, 2319 bp, Neosartorya fischeri
atgtttcacacctttgagggttttgaaaaccctggtgcctcaactccggctaagggtcgggagcgccagcagtccgttgggcggagagtcaccacccttcgggcctgcacctcatgccggcatcggaagatcaaatgcgatggtgagaaaccatgcgaggcgtgtagatggtacaagaaggccgatcagtgccattattcagatccgcgtccttcccgaaggcatgtggaaaaactgtcgaccactctagacgagtatcggagtgttctggagaagttatttcccagcacctcccccgaggcccttgtcagtctaccccgtgagaagctcctggagctgtcgggtaagggcccgtcgcaggcgcatgcacaacatccggcttctcctgccacctctgtgtcagttgaagcgcacgtttcccccatatccaacgaagatggcaacttggaatcattgcagacgatgccagaagatccaagcgacagccgaaaccagagcaccagtgatattacgaatggaatttcggacgatgtaaatgctctatctctctcagctaaacagccttcctcatacctaggcgtgtcatctatacacgctgtcctgaaagtcatcgtctggcttgatccaggatctctctcttatttctctcggacgccggcgagcgctgctccccaagagtcaatgcatgattactcaacagcagccgagcatcagaattggcacatccaatcgtctcagccgcatccggttacaccaccccaggctcatatgcaagcgaccgatatgcagctgctcgacgcatacttcacctggttccagccgtttgtgcccatgctggacgaacaagcttttcgcgagacatacctgtctggacaccgcagagacgaccgctggctcggacttgtaaacattgtcttcgccttgggaagcatagcagcatgcccgtccgatgacatatctcacaagatttattaccagcgcgctaaaagctatctaagcctggattcattaggatcctcgcacctggaaactatccagactttggggttgatgggcggttattatctacactatgtcagtgagccgaatctggcttactcactcatgggagctgcgctccgcatggcggccgccttgggtttgcacaaggagttctcctacagtcaggatgcgtccggcaagcagaaaatttcagcgatggatctgaaacgccgtacatggtggtcgttgttctgtatggatacatggggtggaatgactctgggtcgacccagcatgggtcgtcttggtcccaccattacagtgaagctaccaaatcacagagaaaccggaaacgttctcgatatcctccccctgcttgaaaacatccggttctgcaagattgctacccagatacaagaggttctggctgtcgcaccgttgacgaaacatgccgagatgtcccaactggacagtcagctgttggaatggtacgaaaacctgccctccatcctcaaagaccatgaaccatgctccgaatcgatttcgaacacgcgaaccgtcatgcgatggcggtattataaccagcgcatgctcctctaccggccgaccctgttgagctatgctatgcggcgagttccctacattgcgttgagggcggaggaaaggaccgctattgagaaatgcagagaaatggccgacaccaccattcaagatatctcctcgacggcccagtcgcatcaaatgtccggctggaacgctacctggctcatctaccaggcaacaatggttcctcttctgggtctgttcctcaacgacgccacagcgagtgatcccagagcgtctgtccagtcgtgccagtcgcaggttgagacggcgatgatggtattggcacggatgcagctctcgagtcccacggcgaagcggacgctggaggccgtctcgagaatactcgaagccagcaaacgaggttctgatatgggaggcgcagcgagcggtctcgccagtggaagctgcgctcaggggcgcgaaagcaacatgtcgggaatgatgcctggagtagtctcagcactgaccgaacccggccgcggtgttgcgattgcgaatgacggtggaatggtagatccgatggcaccgccattcatggacgagacgaccggccagcaactttgggacttcctcagctggagcgattcaaccatcttgtctggattctcagagattgagaacccgaacgacatgaagtgcggcggcaatgcacctggcttctatagtcctatgaccgattcaacatattacatgcatccatccgtgccgttttactcgcttgctcaaccataa

SEQ ID NO: 141 - DNA, 2148 bp, Aspergillus clavatus
atgttccatacttttgagatccaccgcaacgagcagcgcacagcacgagatgaacgccgtggtcgtcgaccgggcctacgcgcctgcaaggagtgtcgacgacgcaagatccgctgcactggcactcatccatgcgagccgtgtctctattacaagaagccggagttgtgtcgatattcggatccccgggtgcctcgcagaacgctggacgacagcatcgacacagccaatcagtaccggtcggtggtggaacaattattcccgtccgctcccgtgcagtcactggtgtcgttgtcgcgagaggagctgctggcgctgttgcgcgacagcatcctggtgtcagatggacccacaccgcagcttcctgagacccccggaacggaccagaattctcatccctcgcaagacgattcgctggagaacacggacggcaacgagtcgaacgacgtctcggacgatgtcaatgcgctctccaccgtcactcgcgccccgtccacctatctgggcatctcctccatcaacgccgtgttccaggtgctcaaatggatcgatcctgagtcgctggagctggccgcggcggtcgaggagactccctcgccgggcccggcgggagggagatccccttcgctcaccaaactgaccaactcggtcattccgcaatctcattccactcaatcaaacaacgatctccaactccttgatgcctacttcgactacatccacccttctatgcctctcgtcgacgaacgagacttccggcaaacgtatctcgccggcactcggcaggacgaccaatggcttgccctgctgaacatggttcttgccctgggtagcatcgccctctaccccggtgacgacccctcgcacatagtctattgcaagcgggttcgctcctatctctcgcttgagtcattgggtactgcacatctcgagaccgtgcagaccctcggtctcatggccggccattacctgcattacatcagccagccgaacctggcgtatgtgctgattggcgccgccgtgcggatggccacggcgctggggctgcacaaggaaaacgccgacatcgacgagagcgaaagccggcccttacggccgtccgtgcccgtcgagctgcgtcgccgtatctggtggtcgctgtattgtctggacacctggggcagcatgacgctggggcggccaacattgggccgttcgtcgctggcagtgacgacgcggccgcccgtccagaccgtgggaatcaactcctcgtgtacgctcattctggtcgaaaacatccgctactgccagatcgccacccgcatccaagaggctctcgccgcatcgcccctgatcccctactcacaactccaagacttcgacaacgagctcctcgactggtacgagcagctgccggcgctcctgaagtcctacgagccctgctcggactcgatctataccgcgcgcacccgcatgcagtggagtctgcacaacctgcgcattctgctctaccggccggtgctgctgagcttcgcgctccgccgcgtcccctacgtagccctgcacaccgagcagcggctcgccatcgacaagtgccgcatgctcgccaacgatgcgatccgcgacatcgcgcaggcccgcatccacaaccccactgccgcctggggcgtcatctggcatctgttccaggccacgctcgtcccgctactcagcctgagcgtcgtgctcaccaacacggcgcccatcaccgacgcagaccgcgagctggtcctttcgtgccgcgagcaggtcgagattaccatcggcacgatctcgcgcatcgaggcctggcaccccaccgcccgcaagagcctgagcctcatctcgcgtatcctcgccgcaaccaaagtccgcttcgccgaccctccgccaccaatctaccacccccaaacacaacctcccaaccaacctcaatcccaatcccaaccgcattcccaggccatgaacccggccctccaggtccccgtcatgaccggcatgccctccatctacaccgagaacgagctgagtctgcccagccaggaggtctgggactacatcagctggacgggccaccgggcgtggccggatacgctggcgtcgcaggtgccgaatccggatttctggtccgcgccgggctggtggcaatga

SEQ ID NO: 142 - DNA, 2346 bp, Aspergillus clavatus
atgttccacacctttgagggtttcgagaaccccggtgcttcggcccagacgaagcctcggggagagcgccagccatctgttagccggagagtcactaccctccgtgcctgcacgtcatgtcggcaccgcaagatcaaatgcgatggcgagaagccttgcgaggcttgtcgctggtacaagaaggccgatcagtgccattattcggatcctcgaccatctcggaggcatgtggaaaaactatccaccacgttggatgaatatcgaagcattctggagagactctttcccagcacttccccagaggttcttgtcagtctatcccgggaaaagctgctcgagctctcgggtaagggtccatcgcagcagcaggcacatcatcctgcttctccagctacatcctcatcagtcgaagcacacgtgtcgcccatttccgaagaagatggcaacctggagtcgctgcagacgatgcccgaggaatccaacgacagtcgtaaccgaagcagtgacgacattacgaacgctatctcagacgatgttaatgccctctccctgtccgctcgacaaccctcctcctatctaggcgtatcatcgatccacgccgtcccgaaggttatcgtttggcttgacccaggctctctctcctacttttcccgaactccaccggtcgctcctcgtcgagattcggttcgcgactacccagccggatcggaggaccaaaactggcacatccaatcctcgcagcagcacccgatcacacctccgcaaactcagatgcaagtaactgaagtgcagctactcgacgcctacttcacatggttccaaccgtttgtacccatgctggatgaacaggtattccgcgaaacgtacctctcagggtgcaggcgagatgaccgctggctgggattgttgaacattgtattcgccctcggcagcatagcagcctgcagttctgatgacatgtctcatgcactttattatcagcgtgcgaagagctacttgaacctggactcattgggctcgtcccatctagagacgattcagactttaggcctggctggaggctattatctacactacacaagtcaaccgaacctggcttactcgctcatgggagccgccctccgcatggcagccgctctgggtttgcacaaggagttctcagacagccctgatggctccaacaaagagaagatcctggccatggacatgaaacgccggacatggtggtcgctgttctgcatggacacatggggcggtatgacccttggtcggcccagcatgggccgtctgggaccgaccattaccgtcaagctgcccaatcaccgggaaagcggaaacgtcctggatattctccccctcctcgaaaacgtgcgattctgcaagattgcgacccagatacaagaagtactagcggtcgcacccttgacgaagcatgccgaaatggcccatctcgacagtctgctgttggaatggtatgggaacctgccttcgatcctcaaggaccacgagccctgctctgaatcgatcatgaacacgcggaccgtcatgcgatggcgatattataaccagcgtatgcttctgtaccggccgaccctgttaagctacgcgatgcggcgggtcccaaacattgctctgcgatcggaagagagaaccgccattgagcgatgcagggagatcgctgaagccacgatccaagatatctcctcgacggtccggtcacatcagatgtccggctggaacgccgtctggctcgtcttccaagccaccatggtcccacttctaggattgttcctcaatgaccctacggccagtgaccctcgcgcctcattccagtcctgtcagtcgcaggtggaaaccgcgatgcttctactggcgcggttgcagccctggagtcggacagcgaagcgcacgctcgaggccgtctcacgcattctcgaggccagtaagcgaggatccgacatgggaggcgccccgaacggcgtatccggtggaaacttgcccgatcgcgaaagcctcgtgtcagggatgatgccaggaaatgccttagctcagacggactccggtcggagcgttggtatcgccaacgacggttcaatgatggaccccatggcggcattcatggacgactcggccggccagcaactctgggacttcctcagctggagcgactccaccatttggcccgggtttgcggaggcagacaacgcgaacgagatgtcgtttgcgcaggacgagaagaacgcaaagtacggcagcaacgcaccgggtttcttcggcagtccaatgaccgactcgacatattatatgaactcatccgtaccattttactcgcatgctcaaccttga

SEQ ID NO: 143 - DNA, 3031 bp, Aspergillus niger
attcccagcgtcaacgctgccgatgatcatcaaaccccgaggcttgcctgctcacttccccaaaacaggagctgagttcccgcgtggatatattgtgtttttcttcctctttacaatcttcgtttgatgggcctttctttgcttttcgtctacttcatacctcattgtttccccggacaatgaccactgcagcgactaactgattacctgcataactaactgacttggactactttgcccggtctattcgatccacttgctattttccccctcctgacaaacaaagatccctgctctctggtgcatctaacctactggtttccctgcgactcggtgtcaatggccccttcgagttaatctcgccacccctaaagtgtctcaacgggtacacttcccgactatccgtcaaacaaaaactccagcaaactatcccccgatcgcaacgcaatgtttcacacgtttgaagggttcgagaacccaactcttccggctgctgtgcgcggacgcaatcaacgtcaacaatctgtcggtcgccgagtcacgacgctccgcgcctgcacatcttgtcggcaccgaaaaataaagtgtgatggtgaaaagccatgtgaagcatgcagatggtataaaaaagcagacttgtgtcagtactctgatcctcggccatctcgcaggcatgtggagaaactgtcgaccacactcgatgaattcaggggagtgcttgacaagctcttccctggcattccagcggagaccctggtcaacttgcctcgggacaagcttctggagctgacaggcaaggggccttcccagatgcagacgcaagcgccacacccggcatccccagcaacctcggcatcggtagaggctcacgcatcgccagcatccagcgaagacggcaatctcgagtctctacagacaatacctgatcacacaactgatgatcgtgaattgaaaggttctgagctaacgagtaccgtatccgacgacgttaacgctttatctctctcggccaaacagccatcttcctatttgggtgtctcttccatccatgctgtgctaaaggtaatagtatggctggagccgagctctctctctcatttgtctcgcgcacccgccacaggagtccgtcgagaatctgtcatggacattgcatctccagaggcccaggcctggcaggtttttgggtcacagccccatcatggcacgtccacccatagcccactccaggttcccgagactcaactgctcgatgcttacttcacctacttccaaccttttgttccaatgctggacgaacaatattttcgccaaacgtatctttctgcgcgcaggaaagacaagcaatggctcgcgttacttaacattgtctttgctttgggcagcatagcagccaccccggccgacgacatgtcccatcaagcatattatatgcggtctatgagccatttgaatttggaaagccttggatcaccacacgtggagactatccaagctctgggcctcatgggtggctattaccttcactatagcagccaacccaacctcgcgtactccatgatgggagccgcgttgcgcatggcggctgctctggggctacataaggaagtgtcagatggccagtatggcaatggcaggaataggctatcttcagttgaccataaacgtcgggtatggtggtctcttttctgtctggacacgtggggtggcatgaccttgggacggccaagcatgggtcggctgggtccagcaatcaccgttaagctaccacattacagagaaacaggcaatgtgctcgaccttctaccacttttggaaaatgttcgcttttgcaagatcgcgacacagatacaggaggtcctggccgtggcaccgctgacaaaacctcacgaaatggcacatcttgatagccagcttttggaatggtatgataaccttccttatattcttaaagaccatgagccatgctctgagtcgattgcgatcacgagaaccgtcatgaagtggcgctattacaaccaacgcatgctcttgtatcgccccaccctgctcagctatgccatgcgccgcgtaccatacattgtgctcaggtctgaagaaaggacggcaattgaaagatgtagggagattgccgaggctaccatacaagatgtagccgccaaggcacaattccatcagatgtcaggctggaacgcagtatggcttatcttccaggctgctatggtccctcttctaggcttgtttctcaatgatggtacggttgatgatccaagagcgacagctgaagcgtgccaggctcaagtggaaacaacaatgcttgtcctggagcgcttggaaccttggagtccagccgccaaatcaacgctcgaggctgtttcccgaatatttgaggctggtaaacgtggccccagcgtcatcggggaagcccacagcattaacagcggtagctgtgtaacgtctactgaagagactcttggcgcagttcctggggtatctccgatgcaagtcgactttggtcgcgctattccacacgacagtggatttgtcgacccatttgaaccccagtttatcaatgattctgctggacagtatctatgggactttcttagttggagcgatagcaacttgttgcagggtttggctgatattgacaatgtcaacaatggaccactgtttccccaggaggagagaaatgcaaagtatggatccagcgacactgcgttttttggaggccaattgggagattcaacattttttatcaattcagggccgtccttctactaggctgtacttacagggtgcagccttatcgctgccggtgttcacttttgtcacatggtgttctattattcactcgctctatgtttgttttgttgttccccgccatatgttagcgatctccacattacagaattatttatgattgatgcatttacgggcgattcggaggattcggaggatttatgtcgagaacacggtatcacgatagcaaaaagaactgcttcagcaatatatttttgatctacaaagtgta

SEQ ID NO: 144 - DNA, 2205 bp, Botryotinia fuckeliana
atgcaagttctcagcaccgaggccaagaagataccgctatcgacgtatttttgtcatattccatatcgagttgataaagctgcacttgctgtgatcaatttgcaagttattccagaccccaatccaatccgaaatctatcgaggtgggtcggatactgtccttcggacatcggctcccattttcatgccttcatcaattggttcaacaaagatgtttcatacttaacccttgatgctctctctcaatccctagacgaatgtcgtactgtcttacgtcgacttttcccggatcaagaaatgcaacaattgttgccgttgtcgcgaaatgaactcgtcgccctcatcgaccggtctcctcgaagtgcgctttcaattgcatcgccctctgcttcaaatacctctccaacatcgcaggaatacaggtcgcctttaaactctgggtcggacgagtgtagaagcctggcaaatctcgaacaaataccaaatcaagatatcgaatgggacgaggaaagaagaaatcgagatccaatacccaccgaggcggatgatgtaaatgccttgtctctctcagttgatagacagtcgtcgtacttaggtgcgacttcaatcaaagccgcccttttggttatgctcaaggtagcaccgagactacgatctctcttcttggcgccttctaacaacaggcaaatatcagcaagtagtaactatcctacaccgcgaccaggaagctctgccaaagatttacaagcgatctcatggtcatctaatggccagactcttattgatgcatatttcaatagagtacaaatatttgtaccaatgcttgacgaacccacgttcagagccgactttttgagcgggcgacgtcaagatgcgccgtggcttggtctattaaatatggtatttgcaatgggcagtattgtcgcaagcaaatcagacgaccacaatcatatcaattactacaaccaagcgaaggatcacctgggaattgattcttttggcagcgggcatttggaaacattgcaagctctgtcattgatgggtggattataccttcactacatcaatcgtccaaatacggccaatgctatctgtggggctgctttgagaatggcttgtgcaatgggattgcaccgcgagagtatgcacgagaatagcacggagagcaatttgattgcagaacagagacgaagaacatggtggagtttattttgtcttgatacatgggcatctacgacactaggaagaccttccatgggtcgctggggccatgctatcaccatgcagcctcccgaatcaacacttaacactaaccaaaatatgaatatcactccactggtggagaatatcaaattctgtaaagttgccacacaaatccaggatgctcttgcccagaccccacttctccggaacgatgacctcacaaatctcgatagacagctcgttgaatggtatgataatcttccctggatcttacgctctacagaaccttgtcccgaatcaattcataccgctcgatgtgtcatgaaatggagataccagaaccttcgcatggtactttatagatctgttcttctaaatcttgccaatagaggcaatcaaggaatctcacctaccaaggaagaactcgccgcagtccaaacatgtcgtaaaattgcccaagaatccattgaggatatatcacgagaatggactccgaaccagatgttaggttggaatggtgtttggttcatgtatcaagcatccatgattccacttgtcagtatgttctgggaatcatggaacacgaatctcgtacggatttggcaatcacagattgaagttgtgctcgaagcgtttgatgggatggccgattggtctttggctgctaaacgaagtagggaagtggtgagcaaggtctatgaagtcagtaagcgacctctgactagacagccgagtccggggttgggccacatgacagatgatatgaatcggatggggggaatagatgggagaaattatatggatagtgatatgttgcagcaggttgagattatgggagaagaacaattaatgatgcttgacaatggtgggatatgggacttagacggcatgttatggggaaatttgcctgatggtttggatatgccatatgatggtttgcccatgcagtatgatgattctggaatggctcaattcgaaggaccatatatcttccatcaatga

SEQ ID NO: 145 - DNA, 1554 bp, Sclerotinia sclerotiorum
atgccttcatcaattggttcagcaaagatgttccatacatttcaaggactggcgccaccccgccaaactttaagctccgagcaaacaatccaagacaccccaaaagcgacaacgaatggagtgacgaagagaattacaacaccacatgcatgtgcagaatgtaaacgtcgtgcgacttcaattaaagctgcgcttttggttatgcttaaggtagcaccaagactccgatctctgctagcgccttcaaacaacaagcatattccagcaagcagcaactatcctacgccgggaccaggaaattctgtcaaagaattacacgcagtctcatggtcatccgatggccagacactcattgatgcatattttaatagagtacaaatatttgtaccgatgcttgatgaacccgccttcagagccgactttttgaaagggcgacgtcaagatgcaccgtggcttgcattgctgaatatggtatttgcaatgggaagtattgtcgcgaacaaatcagacgaccataatcatatcgattattataaccaggcgaaagaccatttaggaattgattcttttggcagtggccatttggaaactttacaagccttatcattgatgggagggtattatcttcactatatcaatcgtccaaatatggcaaatgctatctgtggagctgccttaagaatggcttgcgcaatgggtttacatcgagaaatcgccacgcaaattcaggatgccctcgctcaaacgccacttctccgaagcgatgaccttgcgaatctcgatgcacagctcgtagaatggtatgaaaatcttccttggatcttacgctctacagaaccttgtcccgagtccatgtacaccgctcgatgtgtcatgaaatggagatatcagaatcttcgcatcgtgctttacaggcctgttcttctgaacctcgctaatcgaggtaaccaaggaattgcatcgagtaaggaagaaattgccgccatccgaacatgtcgtaccattgcccgagagaccatcgaacaaatatcacgtgaatggagtccaaaccaaatgctgggatggaatggcgtgtggttcatgtatcaagcatccatgataccacttgtcagtatattctgggaatcatggaatacgaatctcgttcgagattggcaatcacagatcgaggttgtgcttgaagcttttgatggcatggctgattggtcgttggctgcaagacgaagtagggaagtcgtgagcaagatgtatgaagctagcaaacgacccctaacgagacatccaagtccggggctcagccagatttcggaagatatgaatcgaatgggtggtatagatgggagacattacatggatagtgagatgttacagcaggttgagattatgggtgaggaacaattaatgatgcttgataatgggggaatatgggatttagatggcatgttatggggaaacttgccagatggcttggatatgccatatgatggcttacccatgcaatatgatgattctgcgatgggtcaattcggaacgccatatattattcatcaatga

SEQ ID NO: 146 - DNA, 2469 bp, Podospora anserina
atggagatatataagtctgcgtctgctccccatgttctcgcctctcttcgtcattacccacatctatctttatccaactttggactttccaacatggccccatcaatcccagttcccacccagggtggcatgttccacaccttccaaggcgtcaccccacggaagcagtcaacagactctcaagatagcacaaagaccagctccacaggtacagccaagaggataacaacaccacatgcttgtgccgagtgcaagagacggaagatccgctgcgatggtcaacaaccatgtggccaatgcctctccagccgggctcccaagagatgtttctacgacaagcacagacaaagagtgatcccatcacgcaagacactcgaagctctatcacagtccctcgaagaatgccggtcgatcctgaagcggttatacccaacacaagatgtgcagtctcttctgcctctctccagacaagaactcctcagccttcttgacaggccaacaatagatacttcggtcggcggcttaccatcaccaccattaaacaccagtcccatgtcggacttggactcaccaatgatgccaaagacggagaacctgctcgagcagatgccatccagagacacagaatgggacgaggagcgaagaggaagagacccgatcccagccgaagccgacgacatcaacgctctttcgctctcagtagaccgccaaacatcctatctcggtgcctcctccatcaaggccgccctcatggtcatgctcaaggtccaacccggcctccgaaactccctcgcagccccattaaacggagtcgagatgtcccacaactacccagccatccgccagaagcccaccacccaaaaggacccccaacgcatcccatggtcctggaagggccaaacactcatcgacgcctacttcaaacgcatccacgctttcgttccaatgctcgacgagtccaccttccgcgctgattacctcgaaggccaacgaaccgacgccccatggctcgctctgctcaacatggtctttgccatgggttccatcgcggctatgaaatcggacgactacaaccacatcaactactacaaccgcgccatggagcaccttcccatggacgcctttggctcctcccacatcgagacggtccaggccctcgccctcatcggaggttactacctccactacatcaaccggcccaacatggccaacgccgtcctcggcgccgccatccgcatggcctccgctttgggtcttcaccgtgagtccatcacggtaggtctcccaggcagcgacatcatcgcagccgaaacccgccgcagaacctggtggtccctcttctgcctcgacacctgggccaccaccaccatgggccgtccctcgttcggccgctggggtcccgcgatcaacatccgcccccccgagttcggcatcaacgccaaccgggattcatcccagcacgcaggaatcctccctctgatcgaaaacatcaaattctgcaagatcgccactcaaatccaagacatgctcgccatcaccccccttctcaggacagaagaccgctgcgccatcgacgcccagctcgtaaactggtacacctccctcccttggctcttgcggacaaccgacccctgcgcggaaccgctctacatggcccgctgcatcatgaagtggcgctaccaaaacttacgcatgctcctccaccgccccgtcctcctctcgcttgcctcctccggcctcaacccccacacccaagcctgcgacgcggacctccaagccattgagacctgccgtgaactcgccgcggccaccatcgaagacgtcggccgtgaatggacccgcaaccaaatgagcggctggaacgcagtctggttcctctaccaagcagccatggtcccgctcgtctccgtcttctggcaatggggctctccccgcgtgccagagtggctcaagcaaatcgagcaagtcctcgacctcctcgaggtcatggaggagtggtccctcgccgcccggcgctcaagagaggtagtctggcgcatgtacgaagcctcccgggcagtccaagcccaaggcgccgctgcccgctcccaatcccccgccggcctccacatcaccaccacagccgacagcatcgtcgtcggcggcggagaggttcacatgagccccattggtctcgagccagtcgacggaatggggggtatgatgggcctgcttgatcaagggggtctatgggatctagacgggatgtactggggtggaaatggccctcagtccccaacacacactggaaacccagacgacagcgccgccgccgccgagtttgccgcttacgctgctgctcaacaagccgcctccgccgctcatcaccaccaccccgagctgatgcagcatgtggactatgggatgatgcaccaccaccacgctggacatcatcacgtggggatggagggctttgggtatgttcagtga

SEQ ID NO: 147 - DNA, 1929 bp, Pyrenophora tritici-repentis
atgtttcacacttttcagtcgtcagtcaacgtgcgctcgcccggcggggacagcgacaacgccgcgaagccctcacggccaccaggatctcggcggatatcgaccagcaacgcatgtgtcgaatgcaggagacgcaagatccgctgcgatggcacacagccatgtgggcagtgccaatggtaccaacatcctgaggcctgtggctactctaagcctgcccaaagagtggtgcccagcaggaagaaacagcgctaccaagccgggcaagttctccgccacctggactcgcagatgacagaccagacgcactaccacctcccggagcacggccaacaactcattgagagttactttgaccgtgtacatcctttcttcccgttgattgatgaacgcaaattctggtctacttatctctacaacaatcgtagcgactcaccatggctagcactcttgaacatggtctttgctctaggttcgcttgcatcccaagctgctgacaatgagacccaccatatctactttactcgctcacgaaagcatttatctctagaatcattcggcagtggcaacctggaggtccttcaagctttagctatcatgagtggatactacatgcactatctcaatcgccctaacgaagcccactcgctcatgggtggtacgctacgcatggcgactgcgctaggcttacatcgcgagtattcggaaagaagcgatgcaagtcgacaaacgaagggtgtgagtgaggaagactcgatatcccctgagatgaggcgacgtatatggtggagtctgttctgtctagactcgtgggcgtcgacaacaacgggcaggccttcgttgggaagaatgggtccctcgattacggtcatgagacctggcactgcagccaacgccattcaaactataccgcctcctaacagtcctcaatacatcgagcaactcaaaattctccctataattcacgcatcagcattctgccagatcgcaaccaagatccaagaccgtcttgtcgaatgtcccctcctgtcttcggtggaaacggctagctacgacgcacagcttgtgaagtggcacgaagacctgccttctatgctgtccaaacctgacgaaccatgcccaaatttcctccgccgtacccggttggtgatgaaatggcgattccaaaacatccgcatcatactccaccgacccatactccttaccacagcactccggcacgcctcatgggctagcctcagtgcagatgaaaaggtgtcggtaggaaaatgtaggttcattgcttgcaagacaatcgaagacataagccgggactgcatgcccgatctcctctcaggctggaacgcagtctggttctgcttccaagcctgtatggtcccgcttgtttctctcttcagcgacccaagtgtacctgaagaagtagaaaagtggaaggccagtatcaagacggcattgaacttcttcgaggcggtcaaagattggagtatagccgcgaagaagagtaaagatgctgttgcgcgcttatatgccgcgtacaagacacaggcttcgacactatctcaacaaacacaaaccccagtgccgcaaatgccctaccctcaacagtatcaacaaccatgccacactcagacacatacacattttcctgtacctggcacatcaaattgtcctgccatgaccaactcgcaaacgacaaactatggacagcaacaacaacctgcgttcatccaatacaaccccgcaacgcccggttgggtaaacactggcaacgacccagctatcctaaacaacttctgggacgacatgatgtgggacaccaacctaccagacatgctggaaacccccttcggaatcgcaactgattacgagtatgtgggtgcagcacaggatcccgggcccggtggggcatgttggatgcatgggaactaa

SEQ ID NO: 148 - DNA, 2238 bp, Penicillium marneffei
atgtttctcacattcgaggcctctcaacacaacaacaacgacaacagaacaagccttcgcaacccaaaacaagagcgtctcaatcgacgacgccgctccacaccgcgagcatgcacttcatgccgtcaacggaaaattagatgtgatggcgagaagccctgtgaggcttgtcggtggtacaagaaggctgagcaatgtagttatccgggacgggagcgagaaagtcactcagaagagatatcattaccggattatcgaggcgcattgaaacggctgtttcccgaaactgcacccgagaatctcgtggatttgtcgagggagagattgctggctttgatatcgaagccgacagacgggtcgccttacatccagcactcccagcatcaagactcattgacaatagccacatccacatctgtagagacgcatgtctccgcactagcaatggaaaggcctggcttggagtcattgcactcaatcccggcagaacaagaacaactcgatgaaaaccggtgtgctagcgcctccgaagagtcagaggagcatatatcagacgacgtcaatgcattgtctctaccggctcgaaatcttacttcgtatctgggcgtgtcgtctattcaagctgcgttgaaagtcattgcgtggcttcatccggaactgaactcacatctttcgcacgtcccaaaagaccagcgtcagcatcaccgtcgttcatcaatttcagctggcttaccaccttcagacctgcaattgctagatgcatactttgacaatttccagccattttcgccactactagacgaggaaacctgccgctcaacctttctgtccggtcgccgaaaggacaatcgctggctagcactactcaacatcatcctcgccctgggaagcatcaccgcagcaggcgtcgacaaccacaaccaccgaacctactttgaacgctcaatgagctttctcaacttcaaaatcctcggtaaccccagcctcgaagtcgttcagactctaggcctcatgggcggctggtactgccactacatcagccaacccaatctcggatacgcgcttatgggcgcctcgttgcgaatggcggttacactgggtctgcaacgagagcctcccttcgatagccatatgtcggcgggcgttagccccgctcgatctgggtatcaggaattcaaacggagggtttggtggtctctttgttgtttggagacttggggtcatgagacgttggggaggccgagtatggattttttcaggccgagtatcacggtcaagttacctcatttacttgataatgagaactatatcaaagtcctccccctaatcgaaaatgtacaattcatcaaaatcgcctccaaaatccaggaatcactcgccgcactacccacattaacgcataccgaactgctcaatctagactcccaactcctccaatggtggaacaatctcccaccagttctcaaggactacaccccctgccccgaagctttgtacgccgcgcgaacagtcatgcgatggcgcttctacaatcagcgcatgctcctttaccgccctcgattgctaaactatgccatgcgccgaatcccattgatcgcaatcaaagacgaggaacgtgtcgccgtacagcgatgtcgcgaaatcgcggaggtcgcgattgaggatatctctacgactactacggcgatgaagatgaatcagatgattgcctggaatgcggtgtggttagtgtttcaggctaccatggtgccgttgatatatctgtcggtcgctgcagttgcagataaacaacgtgacgatggggatgatgttgaaacgtgtaaagcgcaggttcggaggagtatctcgacgctggatcgtatgaggccgtatggccatacagctaagcggtcgtcgggcatgatttcgaggattcttgagattattctgcgtacccctgacactggagtgagggcatctgtcctagaaactcacaacaatgcagggaatacggaaccccagaattatcctccctttctgacgaatcatcaacccatcgcccgagagcgagttctggattggactgctacgactgctgctactaccggtgctaccaataatacgtcttttgaaaattattcgtctcaacatgtgtgggagtatctgagctggggcgagaataatgatttctgggcggagctttataccagtttgaatcctcaggaggaagcaaatttctttgacgctaggattcaatga

SEQ ID NO: 149 - DNA, 2316 bp, Aspergillus flavus
atgttccacacctttgaaggattcgaaaacccgaacaactcggccccagtccggggtcgtggtgagcgccagccatccgtcggccgacgtgtcactacccttcgtgcctgtacatcatgcagacatcgcaagatcaagtgtgacggtgaaaagccgtgcgaagcgtgtcggtggtataagaaagccgaccagtgtcattatgcagatccccggccctcccgcagacatgtagaaaaactctccaccactctggacgagtatcggggcgtgctcgagaaactcttccctaatatccaacccgaaaatttagttagcttgcctcgcgaaaagcttttggagctgatgggcaagccatccctgctgcagacacagcctccacacccagcgtcaccagctacctcggcatcggtcgaagcccatgtctcccccgtctccaacgaagatggcaatttggaatctttgcagacgatgcctgaagaatccagtgattctcaaaactcgggttatacggagatatccaataatttttcggacgacgtcaatgctctgtcactctcatccagacagccctcctcttatttgggcgtgtcgtctatcaatgctgttctcaaagtgattctctgccttgaccctggcgccctctcttacttctctcatccctcgaccaacacagactccagggattcagctctaggatactccccagcagaagcacaaccatggccggtccaagagtctcaacaaccaataacgccccctcaaccacatcgaccagtaacagagatgcagttgctcgacgcctactttacttattttcagccattcgtgcccatgctagatgaggaagttttccgcgaggtctatcactcggggtgtagaaaggatgaacgttggctggcactgctgaacattgtgcttgccttgggtagcatcgcagcatgtccatcggatgacatgtcccacacaatttacgcccagcgctgtaagagctacttgaatttagaatcgcttggatcctcacatatagagaccatccagactctcggccttctgggagggcagtatcttcattatgtcagtcaacccaatctggcatattcgctcatgggagctgcgctgcgcatggctgcagctttgggcttgcacaaagagttttcagataaccaggaagggtcgtgtaagcagaacatatattcgactgacctgaaacggcgagtgtggtggtcgctgttttgcttggacacttggggctgtatgactctggggcgaccgagtatgggacgatttggaccgacgattaccgttaaactgccgcagtaccgagaaagagggaatgttctcgacattataccgcttctagaaaacgttcggttctgcaaaattgcgacacagatccaggaaattctggctgccgctccgttgacgaggtaccacgagatgtcgcactttgataatcaactgttagagtggtatgagaaccttccgtatatactcaaagaccacgagccatgctccgaatcaattatcatcaccaggacagtcatgaaatggcggtactacaaccagcgtatgctcatataccgtccaactctactcagctacgccatgcggcgggttccatatattgctctccgttccgaagagcggacggcgatcgaaaggtgtcgacagatcgcggaggctacaattcaagacatttcttcaacggcccagtcacatcaaatgtcgggctggagtgcagtctggctcatattccaggcagtcatggttcccctattgggattgtttctcaacgacaacacaacgaatgaccctagagctactgttgcgagctgccaatctcaagttgagatggctatgcttgtcctggcccgactggaacaatggagcccgactgcaaaaaggacgttgggtgccgtatcgcagatattggaggctagtaagagagggactaacatggccaacgaggctggccttgtcaatagcatgtttgctgtctcacgcgagggggcagtgcctcgagccgcttcagggtttcatccgtcccaaaacattttccttcagaatgaggcaggctttgatccgtttgcgcctccagttattgacgactcgacggctcagtacctatgggacttcttgagctggagcgatagcagcctatggcctggaataacggacaccaatagcttcaacgacgaaacgctgttcgcccaaacagacaaaaccatgaaatatcccaacaacggtgcagcctttatggggggctctatgggagacggtgcctactatgcaaatccacctttgccctactactaa

SEQ ID NO: 150 - DNA, 2524 bp, Talaromyces stipitatus
atgtttctcacatttgaatcttctcaagccaacaagaccggtctccgtaacccaaagaagcaaatcagtcccacgtcaataacaacaagacgaagcgagcgactcaacagacgccgcaccacgccacgagcgtgcacatcatgtcgtcaacggaaaataagatgcgacggcgaaaagccctgtgaagcttgtcggtggtacaaaaaggccgaattatgttcttatcccgaacgggaacgggggatggggagagaaaggaatagtcaagaagagccggcacactcatcatccgactatcgaaaagcattggagaggttatttccggaaactgcgccggagaatattgttcatttatcaagggagaaattgctgggcttgatatcaaagagttcagctgcaggatcgcagcatcatgattcaatgacaattgctacttcagcatctgtagagacacgccattcaacattgtcgattgaaaggccagctgggctggagtctctacattctataccgggggaacagcagaaacgaatccaccttgacgatgaaacgcaatgtatcgacggttctgaagaggagtctattgaacatatatccgacgacgtcaatgcattatctctaccggctcgaaatctcacttcgtacctgggtgtatcgtcgattcaagctgctttgaaagtcattgcgtggctccatccagaattggactcgcatctttcgcgcctctcttccaaagaccagcgtcgtcagcatcatcgtcatcaagaacaacccggcgtcttacctacagaagagcaaatgctagatgcctactttaccaatttccagtcctttgcaccactcatagatgaagacaccattcgctcgacatttctgtccaaccgccgaaaggacgacaaatggttagcgttactcaacatcatcttcgcattgggcagcatcacagctgcaggtgtggataaccacaaccatcgaacatactacgaacgctcaaaaagctatttgaacatcaacacgctgggtaatcccagtctcgaagtcgttcaaaccctagggcttatgggtggctggtattgtcactacatcagccagccgaatcttgcatatgcgctcatgggtgcatcgttgcggatggcggttactctgggtctgcaacgggaaccccctttggatagaaacctgcctgtgattggaaccgggtatcaggaatttaagcgtcgggtttggtggtctctttgttgtctagagacgtggggtcatgaaacgcttggtagaccgagtatggatttctttagtccaagcattacggtcaatctgcctcgggtgcttgataaggaaaactacatcaaaatcctccccctaatcgaaaacgtgcacttcatacgcctcgcttctaaaatccaagactcgctcgccgcactaccaaccaaaacatactcggaaatgctaaccctagactctcaactcgtagcatggtggaacaatctccctcccgtcctgaaggattgctcgccttgcccagagtccatctggccggtacgaacagttatgcgttggcgattctataatcagcgtatcctcctctatcgtccctcgttactcaactatgccatgcgacagatcccgtttgtggcagtgagagatgaggagagagtggtggttcaacggtgttgtgagattgccaagatggcgattgaggatatttcgggtacgacgacttcgacgatcgggatgaatcagatgattgcgtggaatgcggtttggttagtttttcaggctactatggttccgttgattttcttgtctacttgttctaccgctgctgctgcgacacaagatgatggggaggttgaaagttgtaaagtgcaggttcagactgctatatcaactctggatcgtatgagggtgtatggacatacagccgagagatccctggaaatgatttcggctattctggatactgttttgggtatttctactgtgagagcctataattcagcaggtctcaatgaaaacatcgaatctcagaacttgcctcctatgacggagcatcaaccgattactcgagatcgagttctggattggactgctgctgctaccacttcatcgtcattcgacaatttctcctctcagcatatgtgggagtatctaagctggggtgaaagcaatgatctttggccggagttgtacaccaatctcgatcctcaggatagtcagattgagggtgcggatttcttcaattctaactagtgtatacttttgcttacaaacagactattgacccaaataccgatacttcaacggagcagaactctcatcaagtcccgtaactataaccacctgctcatcaccgggaacaatatccatagcactatcactaagccgcacgttatccctctcttcaaatacaagacatttcacgggcctttgtgcgctgattttgaggatctgttgcttctctccggttgatgatgttcttgtttctggttttacttccagtccacggtctgagaaatcgaggtat

SEQ ID NO: 151 - DNA, 2145 bp, Uncinocarpus reesii
atgttccacatttttgaggggttcgaaaatccagataaggcccggagtcagagccgcgaaggccgtggcaaggctggaaaaagatcctcaacggttcgcgcgtgtgaacaatgtcgacgtcgcaagattcgctgtgatggggaacagccctgcgaagcgtgtcaatggcatgtcgaaaagctatcttcgaccgtcgaggaataccgaaccgttttcgacaaacttttccctagtgttcctttgcaatcccttctaaacctgccgcgcgagaaactcttagagctggcctcaaacgcccaatcgcatcctgaatcttctccggtccctgcgtccgcgtccaagtactcaccgtctgccgaaaaccatgtatccccactcccaccagacgacgaaaacctggaatctctccagacgatgccggacgataccactgagagtcagggatcgagcagctcggacctcttggctacagtctccgatgatgttaacgctttgtctttatcgacaaaacgcccgtcaacatacctaggaatttcttccgtgaacgccgtaatgcgagtaattacttggattgatcctgagagctcccagcatttttcgaggacctccaatcgacagccccgatcgaaacaagagaaagtagcgccccgagacggttctgggtgggctctaccactccaggccccccagcgtggaccatttggaatttttgcactcggaagtatcgccgcatacacggctaacgatacatcacacgagggtttctatttgagagctagacactacttgagcttggacactctaggaaatccgcatttggaaaccattcaaaccctggccctgatgggaggacattatttacattatattagccagccaaatttggcgcattcttttatggcggttgctttgcgcatggccataatgctgggcctacacaaggcattcgcggataatcataatgatgccagcctaggtaaccaaagaaaattctccattgacctacgaagaagaatctggtggtctcttttttgcctggacacttggggatacatgacacttggcagaccgagtatgggacggagcggccccggaattacagtcaaactcccccaatacaatggaaccagggaattggcactgtgtgttctatctttagtggaaaacactcgattttgtaaaatcgcgacgcaggttggggatgccctcgcaacctctccgatcgttgcctattcagaattggttggccttgacgatcagctggttgaatggtttgacaaacttcctccagtgctaaaagatcacgagccttgcccagatcccgtcttgacaacacgtactgtgatgcgatggcggtatcagagtcaacgaatccttcttcatcggcctgtgctactgagttatgcaatgcgtcgtgtcccttatgtggcccttagaacggaagagcgctacgctattgaaaagtgtagaatggtcgctgacgaaacaatccgcgatgtcgcttccaccactcgactgaatcaaatgacgggatggaacgccgtctggcttcttttccaggccacactgattccgctgcttggacttttcatcgctgacagcactgccactcatccatatgccacgttagatagctgcaggaatcaagttgagaccgccatgtgtgcgttggaacgtctggaatcttggagcccgacagccaaaaggactttggaggtggtttcaaaaattttggaagctagccaacggccacgcactaccgtcactagcagtttcatatctggaagccaagctagctccgccgctgtatcattgaacacaccaaacagcagtcctcccgtccacaacatgaatcaagtaccggtacttggtggcacaggcttccagggctaccaagctatcgctccgtatatggggaacacaccacaacaaatgctggattttatcagctggggagacaatacgagtatttggcccagcgcgcaggaagatttctaccctccgccagcgactaccgtggaattgctcggccatagcgagcattatcttaaatcacttggtcatagcgccactgtcacaggtgcaagggaagcgatgtacgacgctggattgccacccacccaaaatgtcgttcggttctcatag

SEQ ID NO: 152 - DNA, 2196 bp, Penicillium chrysogenum
atgtttatcgcgttcaaagctcagaacgaggagggattgcggaacccaaaacataaaaggcgaagtgaacgactcagtcgacgggggtctacaccgcgtgcctgcacttcatgtcgtcgtcgcaaaatcaaatgcgacggcgagaagccctgtgaagcatgtcgatggtacaagaagcctgagctgtgtgcctatacagaaccgcgatcctcgcagcaaagccagccggagaaactgtcaataccctcgcccgactacaaaagcacacttgaacgcctttttccggacaatgcccccgagaacatcgcccatttcccacgcgataaattgttagagttggtgaccgcaggcggaaccccatattctcaccatcaggactcatcgatcgcggccgggtctctagacactcataactctacattgtcgggagagatgcccggccttgaatcactgcatacaatacccggagagcagctcgatgaaaatcaatgtgctagtgcttcggaatcggtaggacatatctcagacgacgtcaacgcattatcgctatcagctcggcacccgacttcctacctaggtgtttcgtctattcaggctgcactgaaggttattgcgtggctccacccagcagttaacacatacttcgcccaatccttgtcgaaagatcaatgttcgcagccacctaatgcgttgcccgcgtcgcgagctgcaccccagcctgaccccccacccacggaaactcaaatgctagacgcgtactttgtcaacttccagccatttgcaccactcatagacgaagaagcctttcgcacgacttacttacttggccgtcggaaggataatcgatggcttgcacttctcaacatggttctcgcactgggaaatattacagcagcaggtgcagataacaataaccaccgggtgtatttcgagcgttcaatggatcacttgaatctacgttctctagggaatcctagccttgaagtggttcaggccctaggacttatgggtgggtggtactgtcactatactagccaaccgaatctcgcatactcccttatgggcgcgtcgctgcggatggcggttacgttaggtctgcagcgcgaaccttccgatattcattcgatgcttgaccctaagaagtccgggatccaggaattcaaacgtcgcgtctggtggtccctttgctgtttggagacctggggccacgaaacgctcggccggccaagtatggattactttggcccgagtatcacagttaatttgcctagccggcttgacaaggaatcatatttcgaggtcctccccttgacagaaaatgtccaatttgtcaaaatcgcattaaaaatccaagaatcgctagctgcgctaccaaccctatcccacgcggagatgttcgatctagacgcgcagcttgtccggtggtggaatgacctaccgccggtccttaaggattacgaaccctgtcccgaatcactatacgcagtgcgaaccgtgatgcgttggcgattctacaatcatcgcatgttactttaccgcccgactctactgaactacgcgatgcgacgaataccctttatggccattcgggtcgaagaacgcaccgccattcagaaatgccaggaaatcgccgcgatttccatccaagacatcttctcgacaaccaaattgaaccaaatggtgggctggaacgctgtttggatgttattccaggccaccatggttccgctgatttgcctgtcggctggcgttgcagatcacgattccgctgcttcattcgaagcttgtaagacgcaggttgaaacggctatgttgacactcggtcgcatgaagccatacggacacacggcgggacgttcccttgaagttatctcgggcattctcgagtcgaaccttcgtgggcccatggcggcgccggtcgatgcaaatggagatagcctcgacccccaaaatccgcagaatcctccaaacccgcagaattttcctcctcccaatgctttcaacgctggtcagcagatctctcgtgatcgtgttgcggattggactgctacttcctttgaaacgctttcgtctcagtacatgtgggagtatctgagctgggaccatagcaatctctggcctgaggtttttgacctcaatactcagaatgataatgtggcaatgtctttcctgaactcacccggaggaaataggtga

SEQ ID NO: 153 - DNA, 2304 bp, Penicillium chrysogenum
atgttccataccttcgaggggtttgagaaccccacggctgcaactcctgcccgcaaccggtctaccagtgaaagacgtgaatctattagtcgccgtgtgacaaccttgcgcgcttgtacatcttgtcgccatcgcaagatcaagtgtgatggcgagaagccatgtgaggcatgtcggtggtataagaagtcggaccagtgtcactattcagacccgcggccctcgcggagacacgtggaaaaactatctacaactctggaagagtatcgaagtatcttggggaagttattcccaaacttctctccagagtcattggtaaatttgccacgtgagaaactcctcgagctcacaatcgccccgtcgggctctcacatgcaaacacagtcacatcatgccgattcaccatccacgtcggtttccatggaagcccacgtctcgcctttgtcaaatgaggatgacaacctcgaggctctgcaaaccatgcctgaggaactaccggatagccgtaatactagctcctcggatctagtagagggcgtctcggatgatgttaatggcttgtcgctgtcggctcgccagccttcatcttacctgggtgtatcatccatccaagctgtgatcaaggtcattgtctggttggatccaggctgcgcctcgtacttttcccgaactcccgtcaacgaacaggaggatgcgatcggatggccgcatcgtgcgcctgtcacacccccgcaaccccttattccgccctcagagatgcaaatgctcgatgcatatttcctctattttcaagcctttgctcccatgatcgatgagcgctccttccgcgaggcttactgcgctggtcgtcggagggatgaccattggcttgctctactgaacattgttcttgctcttggttgcattgcggctacaggacccgatgatacgacacaccagacatacttcctgcgatgtaagagccacctaactctgacttccttgggaagctcccatatcgagaccatccaggcgctgggactgatgggcggctggtactgccactatatcagccagccgaatctggcatactccgttttgggtgctgcgttgcgtatgtcggttgctctgggactgcataaggagtttgcagagacccgccaaataccgagtccagcgaagctagcgtctatggatcttaagcgccgcgtctggtggtctttgttctgcatggatacctgggccggcatgacactaggccggcctagtatgggtcggataggttcaaacattacagttaaacctcccctctgtcgagacaagggaaacgttctcgaaatcctccctttggtggaaaacatccgcttcgccaagatcgccacccaagtccaagagtccctcgccgcagcaccgctagtcaagcaccaagaaatggcccacgcagatgcgcagcttctagagtggtgggacaacctcccctccgttctgaaagaccacgagccctgctcagagtcaataaacactgtgcggacagtcatgcgttggcgctactacaaccaacggatcctcctgtaccgaccaacactgctcagctacgccatgcgccgcgtgccttatatcgcactgcgatcggaagagcgcaccgcaattgaaaaatgtcgcgaggtcgcagatgaatctattcggaatattgctgctacggcgcagcttaaccagctctgcggatggaatgctgtctggtggactttccaggcttctctggttcccttggtgggattattcctcaacgatccaacggcaaatgaccctcgcgcttctattgagtcctgtcaggcgcaggtggaaatggccatgatgaccctggcccgcatgcagtcctttggccatactgcgaagcggtcgctggatgctatctcgcgtatctacgaggctagcaagcggggacaggatcttggcgatcctgattcttccgctagtgttcttagtagcactaacccttatcccgctggtcgggatatgtcagtcatgttcccggcacctgaacagggtcgtggtaacgtggctatgggcgagaatgggttccttgaccccctcgctactaccccgttcgcggatgattcaggaggccagtatctctgggagtatctgagttggagtgacaacaacttgtggccaggaattgtcactgatgttgatgggaggaacgacatgatgactttgttgactccggatcatgagaaaggcccaaaattcggagaacaacctgcgtatttcgatcccatgccggatcctgggtactttgcgaacggcggattttattactga

SEQ ID NO: 154 - DNA, 1728 bp, Verticillium albo-atrum
atgtttcacaccttcggtagcacggacccaccggcttcacatttatcgccacaggtcgcaagaccgatctcccgcagagtcaacaagtcatgttcggagtgtacacggagaaaggtcaagtgtgatggccgtgttccctgtactagctgccagtactacaaaacttcggagagttgcgtctacaggcaacggaccaagagacaagctgtcagcaagagggcattcagtacattggagcaggtgaccgagcaaatgcaggtacaacaacgcattctcaatacattgttcccgcataattcacccgaggacctggttgggagatcaagaacagaacttcttcagctcttgtcgactgcttcgccatccgatacttcggtttgcaatatttcacctgagccattgaggccttcacctcaatactttttatcaggcacaggtggcacagacgtgtctgatggttcaactcaagcatccgaggctggcgatactgttcaagagagaagatgggacgaatcagctcagcagccagcagaaattggcgctagcgatgacatcaatgccatcagtttggctacagatcaacaccgcccctcatatttaggcgtcacctcaatgagtgctgttatgggggcgttattccgactgtgcccagcggctaaagctcgtacgatagaattctcgaaagaattgacaaaagaacagcatccgcctcaccagcaagcttcagacctgatttcgggacccaacttaccggccctcaaccagcttcgagaacagcgctgcgtcgagttctatttcgaacacatacacgccattacacccattttgaatgaagaagagtttcgaagaacatacatagggggcacccggcaagatgcttcatggttgggacttctcaacatgattctgacgcttgggtccattgcctctggcagtaacacattgcacgtgcaatactacaaacaagcgagggttttcctcgacctggactctctcggatcgggaaacatggaaagtctccaggctctgtgcttactgggaggctactacctgcattaccggaattccccaaacatggcatatgctgtgcttggtgctgctcagcgcgtcgccattgccctaggcttacaccgagactcgtcgcgccgtactcatgatcaaggagccgacacaaatcaagaaaatctccttcgaattgaaacgcggcggcggacatggtggagtctattctgtcttgacacttgggccagcatgactcttggtcgcccaacctgtggacgatgggataacacgacaatggacacccagcccccaagcctcctttcacctgatgatcattgtgccatctctttaaggtcgagctgtcagttctgccacatttgcaaccgcattcagcatagatttgcgcagctacgaaggatgtctgccattgaagctcttgctttcgaccaagagcttcgggactggctgtatggtaccacttctttcgatcgccatggagacggcatggaggccgggcttgtaccccgaaaaggtggaccgatggtctgcaagcctgacaaaggctttggacatattcaacgacatgaagccgtggatgaggggatcggatcgagcagcccacatggtggctaccctctttcaggctgtcacggtgacggtcgagaatcaggttcacccatcaaccagtccggaaggggcctgggagttaccaggctggtgcgatga

SEQ ID NO: 155 - DNA, 2490 bp, Verticillium albo-atrum
atgtatcacaactttcagatcgagggaggccctcagccggcgtcagccagccagttgggcggtcttgatgcctcagacacgaagacagtgaaggtctccaaagcctgcgccgaatgcaagcgacggaaaattcgctgcgacggccagcacccgtgccgacaatgcatctcgacgcgggtgccaaagaagtgcttctacgacaagcaccgaccccgagtcgtgccatcaaggaagtacgtgacccccctccaaatcttattatgcggatcgtctattgtcgatcgtggcgccccgcagttgctgacaagagcttgccgcagagttcttgagaatctgtcacagtcgctggaagaatgccgatccgtcatcaatcgtcttttcccgaaccaggaaattttcgatttactaccactgacgcgagaagaactcctggagctgttgcgacatcccacgaaacctcatgacgaggcggtgctgccatccccgcctgccaatccctcaccacttgaggatgacgaggaatcactcgaccaagaggtcgagcctggtgctgccgagcttgagcagatgccgaccaaggactcggaatgggatgaagagcgacgcgaacatgaacccattcccgtcgaatcggacgacgtcaacgccctatcactgacaatggacaagcgggcatcgtacctgggggcctcgtccgtcaaggcggttctcatggtgatgctcaagctcaaaccgcagctcagaaatgccctcgccacgcctcgcaacatggcggctgccacaggtgccatcgccgttcaacccgaagccatgcgccgcgcctcggccgtcgagtcaaaaccagcagcaaaagtgccgtggacatggcgcggtcagacctttgtcgacgcctacttcaagcgggttcacgccttcattccgatgctcgacgaggcaagcttccgtgccgactactccctgggtcagcgcgtcgactcgccgtggctggccctgctgcacgctgtgctggccatgggcagcatcgcagccaccaagtcgagcgacctccatcacgaacagctgtaccagcaggccatgactcacctcaccattgattctttcggatccagccgcgtcgagacggtccaggctctggccattatcggaggcttttatctgcactacatcaaccgccccaacatggccaacgcgattctcggagccgccgtccgcatggcgagtgcactgggcctccaccgagaatcactcgcgcagggcctgtcagaaacagatgtacttgccgctgagatcaggaggaggacatggtggtccctgttctgcctcgacacatgggcgacgacgaccatgggccgtccctcctttggccgccgggggcctggaatcaacatccggtctcccgagctgggcatcagtcaggccgccgagtcagcacagcacgccggcgtgctccccatgatcgaaaacatcaagttctgccgaatcgccacacagatccaggacaccctcgccgcgagctcgctgccctcaaccgacgaccgccagagtatggacacgcagctcgtgacctggtacgagagcctgccctggctgctcggcacgacgcagccctgcgccgagccgctgtacattgcccgctgcgtcatgaagtggcgctaccagaacctcaggatgctgctccaccgccccgtgctcctcacctgggccgcgagccagcagcggccggtgccggcgcggtcgcaccggcgcgcctcgcacgcgccgtcgtccgtgtcgtcgtccgccgacgcggggacgtcgcctgggtcgggcgtgctcaacgacgaggagatccttgcgtcgatcaacacgtgctctgacatggcggcgcagacgattgaggacatcgcgaaggagtggacgcggaaccagatgctgggctggaacgctgcttggttcttataccaggcggccatgattccactccttcggctgtgctggcagccgggcaacgcagaggtggagacgtggaggagccagatcgagacaacgctcgagatcctcgacgccgtcggagactggtcgctgacagcgtgtcgaagccgagaggttgtgaggcgcgtgtacgaagcgagttgtcagaacgaagaggttcagccgtctctgacagcagcagcgaaattgatgggcgccaaccccgtagctcagggcgacatgagcaatctgtatggatcgacgggtggaatgggacagacggcggaggactttgacttccgcatgtctcccattcggcttgacacggatatggaggtcgctgctttcatggagcaggattggatgtgggatctagacggtatgttctggggacagcaacctggcacaaacccacaacagcagcagcagcatccgcaacagcatgcgtcactacagatgcatgatacaaatgtgctatatggagatggcatgacggtcatgcctatgcattacaatatggacaacatgaataacggctaa

SEQ ID NO: 156 - DNA, 2118 bp, Verticillium albo-atrum
atggcgccgtccattcccatccctactcagggtggcatgttccatacctgtgagtcttctgccgccgctgctgctgctgccaggctactcctcgcaacatgggctaacatcttccagttcagggtgttactcccaggaagcccaaaaccgctctcgaggacaatgacaagactcttgttgcgtctgctcacaacacagataaccacagcccacgccagtggcgagacaaaacgcaaagatccctgtggccagtgcctgtccagccgcgcacccaagagatgcttctatgacaagcaccgccagcgagtcattccttcacggaagacactcgaggcactttcgcagtccctcgaagagtgccgctcgatcttgaagcgcctctatcccaaccaagagacccaggccctccttcccctttctcgccaggagcttctaagcctcctcgagcgtccagtgctggacacctcaatcgtgacagctttgccatcaccgccactcaacacttcacctttgtcacaggagctggaatccccgatctgtagctcctcagaacaggggctttcgagcctcgaacagatgcccggtcaagacacagagtgggatgaagagcgccgcgggcgtgaccccatccccatcgaagctgacgatgtcaatgctctcgggctctccgtcgaccgccaatcttcatatctgggcgcctcgtctatcaaggctgccttgatgtgcatgctcaaggttcaaccttcgctgcgtacacagcttaccacgccgctgaacacggccgaggttgcccacaactttccaatccgcccccagcagctgggtcccaaggaaaaccagcgtatctcgtggtcctggaagggccagaccctcctggacgcctacttcaaacgcatcaatgtctttattcccatgcttgacgaggctgccttccgcgccgagtacctggagggccagcgctgcgacagtccgtggctcgccctcctcaacatggtttttgccatgggcagcatcactggcatgaagtcagatgattacaatcacgtcaactactacaaccgcgccatggaacatctgcctctcgatgccttcggcagcagccatatcgaaaccgtccaagctttggctctcatcggcggttactatttgcactacattaaccgtccaaacatggcaaacgccgttcttggcgccgccatccgcatggccagcgcgctgggactccaccggggagagtctggcccagagcgccagggaaatgcttgtgaactggtatgccaacctgccgtggctgttgcgcaccacagacccgtgtgcagacccctctatattgctcgatgcatcatgaagtggcgctaccagaacctccgcatgctgctgcaccgtccggttcttcttagcctcgccagcaacaccagcagcggcgtcatgcttgcccacgttgcggaacaggacatcgctgccattgagacctgtcgtgagctcgccaagcaaaccatcgaggatattgctcgcgagtggactcgcaaccaaatgtcaggctggaatgcagtctggttcctttaccaagctgccatgatacccctaatcagcgtcttctggcagtggaacagccctcgcgtatccgagtggcacaagcagatcgagacaattctagaccttcttgaggccatggaagattggtccctttctgctcgccgcagccgcgaggtggtctggcgtatgtacgaggcttcacgccagcccagcatgcgctccgagagccagagccagagccccgttcttcacgccatgggcagcaacgaacacggcagcattctcatggccgccgaggcggagcttcgcatgtcccctatcggcttggagccagagggcatgggtatgatgggcatgctcgatcagcaaggtctttgggacctcgacggaatgttctggggcggcgcctcaggagactcctcgactgacgcccaaagccacccgcaccaccaacagcaacaacctggcagcgtcgactttggcagcttcagcgtcaacgagcagatgatgcacatggactacaacatgattggcactcccgcttccgcagtgaccatggacggtggcttctttgtccactag

SEQ ID NO: 157 - DNA, 1944 bp, Nectria haematococca
catgcttgcgtcgagtgtaagcggcgcaaaatacgctgcgatgggaaacaaccatgtgatcgatgtcaatcaaggcgctctcaatctcgctgcgtctacgaccaccatcgccaacggatcgtcccctcaaagagagttctcgatgagctttcccagaacttacaagactgccgctctgtcctgagtcggctcttcccaggacacgacgtgtcatcacttctcccgctctcgcgtcaggagctctgccaacttttggaccagccatcatcgcaatcgacagagcctatagaaacccttccatcaccagccctcagcatgtcgaaaattcagctgctcgacgtccaacaaatcccggcgggagatacagagtgggatgaagaacgacgagagcgagatcccttaccagcggaagctgacgatgtcaatggcctgtccctcaccctggacagacaagcgtcatatctcggaatatcatctatcaaagcagctttcggggtcatggtcaagatacaaccgcaattaagaacttcacttgcatctctccaacggaatggttccaagaggaccttggagctcccttccccccagacaggtcaacttgaggagacggccccaatcccctggacgtggaaaggacagctactcattgacaactatttcaagggtctccacgtttttacgcccatgcttgacgaagtttccttccgcgccgactaccttggcggccaaagatgcgatgcgccttggctttcactgctcaacatggttttcgccatgggtgctatcatggcgacaaagtcgagtgacctagaccacttcaagttttacgagaaagctatgaagcaccttagcatgggcgcatttgggagtagccacattgagacggttcaagcgttggctctgctcggaggctattatctccattacgtgaaccgccccaacatggcgaatgctatactgggcgccacaatcaggatggcgagtgcacttggcctacatagagagccaatggctggcgacaacataaatactgcgctagttgagatgcggcgacgcacttggtggtccttgttctgtctcgatacttggaccaccacaacaatgggtcgtccgtcgttcggtcgttgtgatccctcgatcgacattcaacctcctcagataagtatcgatcaggagcgagactctgctcagcacgcaggaatcatgcctctgctagaaaacatccagttttgcaagattgcaacgcagattcatgacatgctggcagccacctctcagcagaccgcagaaagcctgcaacacctggacggcttattggtcggctggtatgacaagcttccctctattcttcgtaaccgggagagttgcgctgagcccctacatctcgctcggtgcgtcatcaagtggagatacttgaaccttcggatgcttctttgtcgcccaatccttctcgctgtagccagcagcgacaaagatgcgccaataagtgaagatgatcttgctgcgatagcaacctgccaggaacttgcaaggcaaacgattgatgatgtcgcgagtggctggacgaagcatcagatgtcaggatggaatgcggtctggttgctttatcaggcagcaatgatacctctcctcagtatcttgtggcagccgcaaagcccatctgttgctgattggcaggctcagatcgaaaagactctggaagtcctcgaggcgatggaagattggtcgctcacagcgcgttgttcacgggacgtggttaagcggatatatgaggcgagccgtcagctttcaggccagaatgaaggcgtttctgccgtagagagtgaccgtttgccagaatttatggaggaggacttctatgcttgggcagaagggctcgagttggaccatatggtaaatatgttggatcaagagtggcaatgggatatagggccagggcagtag

SEQ ID NO: 158 - DNA, 1962 bp, Nectria haematococca
atgtttcacacattttcaagccagactggagatgatcctttgccgccaggtgccgagccggaaccccctgtgcgaaaagtcaacagcgctctagacaaggccacggaaacgcttcgacgtcaagccggtgttctacaactactatttcccaatcacaggcttgatgaattggtcgacaaggatcgagctgatctcatccagcttatttcgccaaaaccaacacgggaccacgtcaacgaagagagaacgctacaatcacctgacccactgcccacgactgggtcatctgggctatcaggggacattgaagatgtaccaagctcgcccgaggatttgagcataggtgaatcaggcgaggaggagaggcgctggcatgagtcggctcaggatcccgcgaccatcgcagccagcgatgacatcaacgccctcagcctggctggtgaccaacatcgccgctcatatctaggaattacatctgtgagcgcagtgctgaaatctttgtttcgactttgtccaactgcgaaggatcttgctgtcgaacagtcccagacctggcctggcgtttcggaagatgagactcgaccgctcgtgctaaaccgtacgcctggttctcttgcggcgcccgattctctgcgtgagcaacgctatcttggcttctactttgagcacattcatgccattacacccttaatcgacgaggactcgtttaggagcactttcactactggcggtgggcaaagcccggcgtggcttggtctctgcaacatggtccttacactaggctccattgcttcgggaagcgacactgcccatatccactactaccaccgggctcgctcgtacctcgatctcgactcacttggttcagggaacctggagagcctacaggcgctgtgcctacttggcggatactacctccattatcgcaactcgcctaacatggcgtatgcaatcttgggcgctgcacagcgcttagccatcgccctgggtttgcacagagagtctccgatccgtgctgaccacaaagactccgaagcaggccaacgttatgtggctcggatcgagactcgaaggcggacatggtggagcctttactgtctcgatacgtgggccagcatgaccttgggtcgcccaacctgtggacgatgggacaccaataccatgaacacattgccacctacgcttctggggcccgatgatcactgtgcggtatccctcagagagagctcacggatgtgccatatctgcaatcgtcttcaagaccgatttgcccagtctacgcgaatcgatactcacgaagcaagggccttggattctgaactacagagctggtacgactcgctacccgccatactcaaggacacaaccgatgcccctcctcgcatcaccgtcgcacgcgagttcttgcgtaacagatattatagtgttcgcatgatcctatctcgatgctttcttttgtatcgcgcccacgaagatataaaaaggcacactcctaacccggcagagagccaaatgatcgacctgtgcagagctgttgcagcagaagccatcgatgctattgcacttcattgggtcccgaaccgaatccaagtctggaactcggcttggtacctgtttcaggcatgcttagttcccctcctctccatcgctatggagacatcatccaactcttcagactctgagccggaaaccgtcatggcctggcgcacgatgttgaacaaagccttggaagttttcgtggacatgaagccgtggatgcgggcttctgaccgtactccagatatcgtggctgtcctattccaggctgtgtcacagggcgccgagggaatcattcgcacgccatcggtgactgacgcaggggcacatgtatttggatgggctgatgaacagtggacagagatggattggagtttgtttcttggcgacgaagatatttctcacaatctgttttcttttacataa

SEQ ID NO: 159 - DNA, 2401 bp, Coccidioides posadasii
atgttccatattttcgaaggattcgagaatcccgataaggcccggagtcagagccgcgagggccgtggcaagagcggaaaaagatcctcgacggtgcgtgcctgcgaacaatgtcgacgccgcaagattcgctgcgatggagagcagccgtgcgaggcgtgccagtggtataaaaagactgatctgtgtcattactcggatcctcgcccgtccagaaggtatccacttcctgttttcattcgttcattctcgctgaagtcttggcatgtcgaaaagctatcttccaccgtcgaggagtatcgagtcgtgtttgagaaactctttccgtccattcctttgcaatctctctccaacctcccccgcgaacgccttctagagctggcctcgagaacccaaccgcagtccgaaattcttcctgttcccgtgtccaagcccccaccgtctgtcgataaccatgtcctccctctccccccagaagatgaaaacctggaatccctccagacaatgcccgatgattccaccgagagtcgtacatgccggagcccagatctcgtcgccgctgtgtccgacgatgtcaacgcgttgtccttatcaacaaaacggccctcaacatacttggggatatcttcggtgaatgctgttatgcgggtaataatgtggattgatcccgagagctctcagcatttctccagggctcccgatccgcaacccctcccaaaacgggagaagcaacctctcccggataactgctcttggtccttgcagcccccaccttccacggctgggcatctggaagtaaatcccatggagcttaccaacgcgtacttcgcatacttccactccttcgctccattgctggatgagcacttattccgcgaaactgtcctggttcgtaaaaggtccgatccgcgttggctagcactccaaaatattgtttttgcacttggaagtattgctgcatacacggccgatgatacatcccacgagtcctactatctaaaagctagacactatttgagtttggatacccttgggaatccgcatttagagaccatccagacccttgccttaatgggaggccattacttacattatatgagccaacccaaccttgcacattctcttatggcagttgctctgcgtatggccactgttctaggtctgcataaagaattcattggaaatcaggaagctgctagtcaaaacagccaaagaaaattctctgtcgatttacgaagaaggatctggtggtctctcttctgccttgacacttggggctatatgacgttgggtagaccaagtatgggacggtggggccctggaattacagccaaactcccacataaccatggaaacaaggaacttgccttttatgcgctttccttagtagaaaacactcggttttgcaaaatagctactcaggtgggagacgctcttgcagcttctccgattgtcagctatcaagaaatggtcagtctcgataatcagttggtcgaatggtatgacaatcttcctccgctcctaaaggatcatgaacccagtgcagatccggtttctacaacgcgaaccgtgatgcgatggcggtatcaaagccagcgtattcttcttcatcgtcctgtcttgctaagctacgcgatgcgtcgtatcccctatgttgcactcagaacagaagagagatatgctattgaaagatgcaggatggtcgctaatgaaacaattcgggatgtcgcttcaactactcgcttgaaccaaatgacaggatggaatgctgtttggctcctcttccaagccacactagttccgctccttgggctttttattgctgatggaaccgccacccatgcgcacgcaacgtcggatagctgcagaaaccaagttgaaacggcgattgttgcccttgagcgcttggagaactggagtccaactgccaagagaacgttggaggtagtctctcgaatcctagaaactagccagcgaccacgccacaccagcgtcggcagctgtacatctggaagcgacacccacacagccggcatgagtgatcagtctgccaccgcttcatcggaaacatcaaacaccgcgccttctattcacactatggaccaaacagccgtccttagcaatgctgcgttccctagttaccagaatattgcaccatatatacagccatcaccgcagcaaatgttggattatattacatggggggataataacatctggtcgagcgtccaagaggatttttatactcaacaaccccccgctgtggggatgtttggccagggtcaacagtaccttaagcctcttgatcatgaacctcccgcggttggagaaagggctggagtgtatgataccggattagagactccgaatattgtacggttttagttaagcggtatataat

SEQ ID NO: 160 - DNA, 2316 bp, Aspergillus oryzae
atgttccacacctttgaaggattcgaaaacccgaacaactcggccccagtccggggtcgtggtgagcgccagccatccgtcggccgacgtgtcactacccttcgtgcctgtacatcatgcagacatcgcaagatcaagtgtgacggtgaaaagccgtgcgaagcgtgtcggtggtataagaaagccgaccagtgtcattatgcagatccccggccctcccgcagacatgtagaaaaactctccaccactttggacgagtatcggggcgtgctcgagaaactcttccctaatatccaacccgaaaatttagttagcttgcctcgcgaaaagcttttggagctgatgggcaagccatccctgctgcagacacagccgccacacccagcgtcaccagctacctcggcatcggtcgaagcccatgtctcccccgtctccaacgaagatggcaatttggaatctttgcagacgatgcctgaagaatccagtgattctcaaaactcgggttatacggagatatccaataatttttcggacgacgtcaatgctctgtcactctcatccagacagccctcctcttatttgggcgtgtcgtctatcaatgctgttctcaaagtgattctctgccttgaccctggcgccctctcttacttctctcatccctcgaccaacacagactccagggactcagctctaggatactccccagcagaagcacaaccatggccggtccaagagtctcagcaaccaataacgccccctcaaccacatcgaccagtaacagagatgcagttgctcgacgcctactttacttattttcagccattcgtgcccatgctagatgaggaagttttccgcgaggtctatcactcggggtgtagaaaggatgaacgttggctggcactgctgaacattgtgcttgccttgggtagcatcgcagcatgtccatcggatgacatgtcccacacaatttacgcccagcgctgtaagagctacttgaatttagaatcgcttggatcctcacatatagagaccatccagactctcggccttctgggagggcagtatcttcattatgtcagtcaacccaatctggcatattcgctcatgggagctgcgctgcgcatggctgcagctttgggcttgcacaaagagttttcagataaccaggaagggtcgtgtaagcagaacatatattcgactgacctgaaacggcgagtgtggtggtcgctgttttgcttggacacttggggctgtatgactctggggcgaccgagtatgggacgatttggaccgacgattaccgttaaactgccgcagtaccgagaaagagggaatgttctcgacattataccgcttctagaaaacgttcggttctgcaaaattgcgacacagatccaggaaattctggctgccgctccgttgacgaggtaccacgagatgtcgcactttgataatcaactgttagagtggtatgagaaccttccgtatatactcaaagaccacgagccatgctccgaatcaattatcatcaccaggacagtcatgaaatggcggtactacaaccagcgtatgctcatataccgtccaactctactcagctacgccatgcggcgggttccatatattgctctccgttccgaagagcggacggcgatcgaaaggtgtcgacagatcgcggaggctacaattcaagacatttcttcaacggcccagtcacatcaaatgtcgggctggagtgcagtctggctcatattccaggcagtcatggttcccctattgggattgtttctcaacgacaacacaacgagtgaccctagagctactgttgcgagctgccaatctcaagttgagatggctatgcttgtcctggcccgactggaacaatggagcccgactgcaaaaaggacgttgggtgccgtatcgcagatattggaagctagtaagagagggactaacatggccaacgaggctggccttgtcaatagcatgtttgctgtctcacgcgagggggcagtgcctcgagccgcttcagggtttcatccgtcccaaaacattttccttcagaatgaggcaggctttgatccgtttgcgcctccagttattgacgactcgacggctcagtacctatgggacttcttgagctggagcgatagcagcctatggcctggaataacggacaccaatagcttcaacgacgaaacgctgttcgcccaaacagacaaaaccatgaaatatcccaacaacggtgcagcctttatggggggctctatgggagacggtgcctactatgcaaatccacctttgccctactactaa

SEQ ID NO: 161 - DNA, 2364 bp, Pyrenophora teres
atgtttcatactttccagtcgtcagtcagcgtgcgctcgcccggcggggacagcgacaacgccgcgaggccctcacgcccaccaggatctcggcggatatcgaccagcaacgcatgtgtcgaatgcaggagacgcaagatccgctgcgacggcacacagccatgtgggcagtgccaatggtaccaacatcccgaggcttgtggctactccaagcctgcccaaagagtggtgcccagcagaaaactagttgacaaactctctaacaatttggatttgtacaagaccattctgacaaagctgtatgggacacaaaatctcgagtctctggccactctcccacgggaagagttgctggagctggccttgtcctctacagtagccaactcaacaacgtcaccatcagcccccgactcccaaacttgttccgaagcacaggctggctctgatggagccgaaagtctagaagcgcttgagcaggctccccccgaagatccttactgggatgaggcacggaagcaccagctgcgtgtccaaggcatctctgatgacgtaaacggtttgtcaatgtctgttgaccgtctatcgtcttacgttggtgtttcttcaataacggcagcattgaaggtcattgtacgatgcgcacctcaagcacgatcttttatttcaaataacaaccaggaaacagccctaccaagccgagcaagttctccaccacccggactcacagacgacagaccagacgcactaccgcctccggagcacggacagcaactcattgagagttactttgaccgtgtacatcctttcttccccttgatcgatgaacgaaaattctggtctactttcctctacagcaatcgtagcgactcaccatggctggcactcttgaacatggtctttgctctaggctcgctttcatctcaagctgccgacaatgaggcccaccatatctactttactcgctcacgaaagcatctgtctttggaatcgttcggaagtggcaacctagaggtactccaagctttagctatcatgagcggatactacatgcactatctcaatcgccctaacgaagcccactcgctcatgggtggtacgctacgcatggcaactgcgctaggcttacatcgcgagtactcggaaagaagcgatgcaagtcaacaagccaagagtgtgaatgaggaagactcaatatcccccgagatgaggcgacgcatatggtggagtctattctgtctagactcgtgggcatcaacaacaacgggcaggccttcgttgggacgaatgggtccctcgatcacggtcatgagacctggcactgcagcaaacgccgtccaaactataccgccacccaacagtcctcaatacatccagcaactcaagattctccctataattcacgcatcggcattctgccagatcgcaaccaagatccaagaccgtcttgtcgaatgtcccctcctgtcttcggtggaaatggctagctacgacgcacagcttgtaaagtggcacgaagacttgccttctattctgtccaaaactgatgaaccatgcccaaacttcctccgccgtacccggttggtgatgaaatggcgattccaaaacatccgcatcatacttcaccggcccatgctcctgaccacagcactccggcacgcctcatgggcgagccttagtgcagatgaaaaggtatcggtaggaaaatgtcggctcgttgcttgcaagacaatcgaggacataagccgggactgcatgcccgatctcatctcaggctggaacgcagtctggttctgcttccaagcctgtatggtcccacttgtatctctcttcagcgaccccagtgtacctgaagaggtagaaaagtggaaggccagtatcgagacggcactgaacttctttgaggcggtcaaagattggagtatagccgcaaagaagagtaaagatgctgttgcgcgcttatacgccgcgtacaagacacaagcttcgacactatctcagcgaacacaaaccccagtatcgcatatgccctaccctcaacagtatcaacaaccaggccacactcagatacatacacattttcccgtacctggcacatcaaatggccctgccatgattaacccacaaacgacaaactatggacagcaacaccaacctccgttcattcaatacaaccccgcaacgcccggttgggtaaacactggcaacgacccagctattctaaacaacttctgggacgatatgatgtgggacaccaatctaccagacatgttggaaacccccttcggaattgcaactgattacgagtatgtgggtgcagcacaggaccccgggcccggtggggcatgttggatgcatggcaactaa

SEQ ID NO: 162 - DNA, 2412 bp, Sordaria macrospora
atggcaccgtcaatttcgatacccacacaaggcggcatgtttcacacattccaaggagtaacaccacgaaagccatccgttgactctcaagatagtgtcaagtccagtggtagtggggcagccaaaaggataactactcctcatgcttgtgccgagtgcaaaagacggaagatccgatgtgatggtcaacaaccatgcggtcaatgtctctcgagccgagcaccgaagcggtgtttctacgacaagcaccgccaaagggtgatcccctcgcgcaagacactcgaagccctctcccagtccctcgaagaatgtcgatcaatcctgaagcgactatatcctaaccaagaagtccacgccctacttcccttgtcaaggcaagaactcctcgacctcctagaccgacccgttccagataacgcggggaacgggctaccgtctcctcccctaaacacaacatcgatggccgacttgaattcaccaatcaagtctgaaaacattttggaacagattccgacccgggatacagaatgggacgaggaacgccgcgagagagaccacatccctgcagaggcagatgatatcaacgcactatcgctgtcggtggacagacaagcttcctacctcggagcctcatccatcaaggctgctcttatggttatgctcaaggtccaaccaggattgaggagctccttggccgccccgctcaacagtgtcgagatttctcataacttcccggccatcagacagaagtcatcgactcaaaaagatccccagcgaatcccgtggtcgtggaagggacagacacttattgatgcctacttcaagcgagtccatgtcttcattccaatgctcgacgagaccaccttccgcgccgattaccttgaaggtcaacggttcgacgcaccttggttggctctactgaacatggtctttgccatgggtagcattgtggcaatgaaatcggacgattacaatcatgtcaactactacaaccgcgccatggagcatcttcccatggattcttttggcagcagccacatcgaaactgttcaggcactggcactcattggcgggtactatcttcactacatcaaccggcctaacatggccaacgccgttttgggtgccgccatccgcatggcgagcgctctaggtctccaccgtgagagtcttacccagggaggaagtgatatggtcgctgctgagaccaggagacgcacatggtgggctcttttctgcctcgacacctgggccaccacaactatggggcgtccatcttttggccgctggggacctgctatcaacattcgtcctcccgagttcggagtaaattccggccgggattcgtctcagcatgctggtattctccccatgatcgaaaacatcaagttctgcaaaatcgccacccagatccaggatatgctcgccatttctcccttgctacgtactgaagaccgctgcaatcttgacgggcagctcgttgcctggtacaacaacctaccctggcttctgcgcaccactgacccttgcgctgagccgctctacatggcccgttgcatcatgaagtggcgctaccagaaccttcgcatgcttcttcaccgaccagtccttctctctatggcctcgtcgggtcttaacccccatacccaggcctgtgattcggacctggccgcgattgagacatgccgtgaacttgctgcggcgaccattgaggatattggccgtgaatggacacgtaaccagatgtccggctggaacgcggtgtggttcctttaccaggctgccatggtccctcttgtctctatcttctggcaatggggcaacccacgcgttcctgagtggctcaagcagatcgaggcggttctggagttccttgaagccatggaggagtggtcgcttgctgctcgcaggagcagggaggtggttcttcggatgtacgaggccagcagagtcatccaagcacagggcgccgcggcgcatcaactacagcagaggcgttcgcagagccctcactctgtcaacggcaccgggcctttgggtatgcacatcaacaccgacttgctcatggggtcaccggattcggctgagctacacatgagtcccatcggcctggagcccgtcgaaggcttgggcatgatgggtatgctggaccagggcggcatgtgggacctcgacggcatgttctggggccccagcccaagcccacctcatcatggccatcacccaactcacccggatgatgcggtggccacggcggcggatttcgctgcagcgttcccgacggctgatggagcagatggacttctgcatcaccattcggctatagaatatggaaacttgatgggtcaccaccatgcagatgcacatactggccagggtcagtttggaggtgtggatgggtacagctactga

SEQ ID NO: 163 - DNA, 2346 bp, Magnaporthe oryzae
atggcgccggcaacatctccagcccctacccagggcatgttccacacctttcaaggtgtcacacctcgaaagcaaacttccgaggctcctgggagcccaaaagctgccaaccccgtcagcaattccaagcgcatcaccacacctcacgcctgtgccgagtgcaaaagacgcaagatccgatgtgatggacagcagccttgcggccaatgcttatcaagccgtgcccctaagaggtgtttttacgacaagcacaggcagcgggttatcccatcaaggaagacgctagaagcactttcccagtcattagaggaatgtcggtccatcctcaagaggctatacccgagccacgatgtccagtctctgttgcctatgtcccgtcgtgatctccttgatctgctcgatcgtccaatactcgacacaactgctgcagctcttccatcaccgcccttgaacacctcgccgctcagtgacgaaattcagccccctctcttcatcaagccagaccaggttctttcgagtctcgagcagatgccatccagggacgcggaatgggacgaagagcgcagggagagagacgccattccggcagaggccgatgatgttaacgcattgtccctcaccatggatcgacaggcttcgtatcttggagcttcatctatcaaggcggccctgatggttatgctcaaagttcagcctggcctgaggagcactctctcggccccgcttaacactggcgagatgccacacaactacccgtctaccaagtcgagggctggcacccacaaggacccccagcggatcccatggtcctggaagggccagacactgatagatgcctttttcaagcggattcatgtcttcatccccatgctggacgagacaacattccgtgccgactatcttgagggccagcgcttcgacgccccttggctagctctgctcaacatggtgttcgccatgggcagcattgttgccatgaagtctgatgattacaatcacgtcacctactacaaccgcgcaatggagcaccttccaatggatgcctttggaagcagccacattgagaccgtacaagcccttgccattattggtggctactacctgcactacactaaccgccccaacatggccaacgcagtgctcggcgctggcatcaggatggcgagtgctcttgggctccaccgagagtctctgacacagagtgcaggcgatgtgcttgtggctgagactcggagacgcacctggtgggcgttgttctgtttggacacatgggcaactacaaccattggtcgaccatcttttggtcgctgggggcctgctatcaacattcgggtgcccgaatttggcatcaacgctgcgcgcgactcaacacaccatgcaggcatcctgccaatgattgagaacatcaagttctgcaagatctcgactcaaattcaagacatgcttgccgtctctccactcctcaggacggatgaccgctgccacttggatgctgccctggtcgactggtacgccaacatgccgtggctccttcggacgacggacccctgtgcagagccgctttatattgcacgatgtgtcatgaagtggcgataccagaaccttcggatgcttttgcaccgatcagtgctcttgagtcttgcctctagcggctcgactcacgcagcggagcacgacattgcagctattgaaacctgcagggacctggcacagcaaacaattgaagacattgctagagaatggacccgcaaccaaatgtctgggtggaacgcagtctggtttctgtaccaggcggccatgatcccattggtatcagtgttttggcagtggaacagcgcgcgagtgcccgagtggcacaagcagattgagaccgtcctagaactcctcgatgcaatggaagactggtctcttgcagcgaggcgcagtcgcgaggtcgtatttcgcatgtacgaagcatcacgcaatctgcagaggcagcagcagcaccaccgttcacagagcccggccgactctactacctcatcacatcacatgggcatgacgggcgggcgcacctccccaagattgattatcggcccctcggcagatactgccgttgagatgccacacatgtcgccgatcggcatagtcgaccccgaaagcattatgggaatgatgggggtctcggatcagcagagcctttgggatctggacggtatgctctggggacagcacgacgaatttgacgccggcgcttatggattccacgataacatgatgatgagcatggattacaacatgatgggaaacgacatcccagccacgacggccgcagccttggaccacggctatccctacgtccattag

SEQ ID NO: 164 - DNA, 1992 bp, Gibberella zeae
atgcgggggcaggaagaagctttcatcccttggattgacaagtatggggaacttctgcgcgtctgtggcattcatgagaatgtaggcacatcagaatacgcaaggccattctccacagtcacgccaccttttatctcaagcctatcgactgatctcatgtctcctcacgcacatcgaatgagaaaagaagtctacgcgcatgcgaagattgcaagcgccgaaagaacacttgaagacttatccaaaagtctcgaggaacgcgattccattttagctcgcctttttccaaaccgagatatatcagatcttgtttcattatcggaccaggaacttcgtgatattgtcttgaacgctggtcctagtcctaatggcacgaccttgacctttcggtcggatcatacaccaaacgaatcgattactcaagactcgcaatgggatgaagatcgacgcgaacgtgatcctttacccgccgaagctgatgatgtcaacgctttatcccttccgttagaccgtcaggcttcttacctcggtatatcatccatcagggcggctcttggagcaatacttcagatgcgacctcagctacgtgcttcactcgcatctcggcaggagtcctacaatgaaacttcttctttacgcgataacggtatgcagtgtactcagatggttcagtctccaacagagaatccttgcgttaagtggagtagaaagggacaggcacttgtcgatgtatacttcaagcgaatacacataatgactccattgcttgatgaaacatcctttcggacaacctacctcagtagtaatcggcatgactcgccttggcttgcactgctgaacatggtacttgccatgggcagtattgcagctagcaagtcaagtgatcgggaacactacaaatactatacaaatgctatgcggcatctagatattagtgcctttggcagcagtcagatcgaaacgttacaagcacttgctatcgtcggaggtcactatcttcactacatcaatcgacccaacagaggcaatgctatcttaggtgcggctttccgtatggctagtgctcttggttttcatcgcgagccatcagaccaagacaaagaaggtgatcagctccaggtcgtggaattgagacgccgtatctggtggtgtttagtctgcttagatacgttagcctccatgaccttgggtcgaccatcttttggccgcttttgtccttccattgatatccaaccaccaaagttcagcaccggcgggcatggacagctggactcggagcctgacatggatataatgctactcgccgagaatattcgcttttgcaggatcgccactgagattcaggacaagctcaccgtcactccttttctcaaaccctctgaccgggatcgattcgatgatatgttgatcagttggtttgacagtcttccatcacttcttggtgacgatcaagagtgcgatgagctggttcaccttggtcgatcattactggacgctgcatcaaaacctggcgtgtactctcagccagccgaccaagatgccatcgaaaaatgtcaactgctttccaagacagctatcgaggatatagctcagagttggaagaacgatcagatgtcagggtggaatgcagtatggcatctttaccaagcagtcatgattccactactgagtatggtatggcagcctcagaaccctgcagtttcggaatggaaaagccagatcgaaatggtgcttgggctatttgaaagcatgcgtgattggtctttgacggcacgttgtagtaagagggttgtcagtcagatctacgaaacaatcccaatctgctgcaacgctgaacgtcttcaactcggaagcttcgacatggagaggagcagccacatgattaggctgtcccactcctcgcagtaccgtgactcgagttttatggaaagggtcaaggtccttctcattaacctcaaaaccgccgaagcccttaaaattgggtcaagttag

SEQ ID NO: 165 - DNA, 2322 bp, Aspergillus nidulans
atgttccacaccttcgagggcttcgagaatccagccgcctcggcccccgcccgtgcaggacgagaacgccagtcttcaatcgggcgtcgcgttaccactcttcgtgcttgtacctcttgtcgtcatcgcaaaatcaaatgcgatggtgaaaagccgtgtgaagcatgtaggtggtataagaaagccgatctttgccattattcggatccccgtccctcgcgaagacatgtcgagaaactgtcaacgaccttggatgagtaccgaaccgtactggagaagctgtttcctggcgcatcgccggaagccttggctaatttgccgcgcgagaaactgctcgaaacactagctcagccccaggcgcagcctccaagtactggagcccgccagatatcgccagcaacgtccacctcccacgaggcgcacgtctccccgatatcgaccgaggatggaaatctggagtcgctacaggccatgccagaagaatcgaatgacccccgcaatctcagcagcgagatcacgaatacaatatccgatgatgtcaatgcgttgtcgctttccacaagaggcccgtcctcgtacctcggtgtctcgtccataaacgcggttctcaaaacaatcgtgtggctggatccagggtccgctgcatattttgccagtacgcccccaagcgctcctcgtcgaggctcggtagcagacctctcttcgtcggaggggcagtcttgggctgcccatgaccagcccggtactcctccgcaagttcatctacaagtgccagaatctcaactcctggatgcttactttacctatgtccagcccttgacaccaattctggacgagcagtcctttcgcgaaacatacgctgctggacaccgaaaagatgaccggtggtattgcttgctgaatatcgtcctcgcgatgggcagtatctgcgcctcaacctgcgacgatatttcacataagatatattactcccggtgtagggcgtacttggacctggagtcgctcgcgtcactgcacctggaaaccgtgcagacgcttggtattctagggggctggtacctgcattacgttgcccaaccgaatctagcgtactcacttatgggcgccgctcttcgcatggctgccactatgggtttgcatagagaattcgccgaccaatccgatacatcgaacaagcagaaaatggcacaacttgatctcagacgacgggtatggtggacactgtttcttatggattgctggggaggcgtgactttgggacggccaacaatgggccgattcagtcccgcgattacggtcaagcttcctcactatagggaatcggggaatgtacttgatattcttccgcttctcgagaacgttcgattttgcaagatcagcaatcagatacaagacgcgctagcagtgtctccattgaccaaatacagtgaaatactccacttcgatactcaattggttgagtggtacaacagcctcccatatatccttaaagaccatgaaccatgcccggaaggaatcgcaaacacccgcgaagtcacgaaatggcgatatcatgtccaacgcatactcctctaccgtcccacactattgagctatgccatgcggcgggttccgtatattgctctacgatccgaggagcggacggcgatcgaaaggtgcagagaaattgccgaaaccgccatcagagacatctcggcaactgcaaagacccctcagatgtctgggtggaacgccgtgtggttcctcttccaaagcaccatggttccccttctagggctgttcatcaacgacaatacagtgacagatccccgggctactacagaggcgtgccaagcgcaggtccaagacgctttacttgtgtttgcgcgtcttcagcaagcaagtccgacggcaaggaaaaccctcgacgcagtttcacggatatttgaggccagcaaacgtggtcccggcatagctgccgaaaccaacagcatcaacagcgctaatctctccccaacttcgcgcgaggctggtgttcttaacacacccggaatcttaccctctcacaacgatggacgaggatttgcagttactcacgacagctcgttcaccgatccattcgccccttcaaccatggatgaccctaacggtcaatatctctgggacttccttagctggagcgataccaacatagtcccaatggcagacgtggaaaatatcaacgacggcggcctgctaggctccgatgacaagcatttcaagtatacgaataccagcttctttggcaaccagctaactgaaccgccttttttcactaattcatctattccatattattcgtga

SEQ ID NO: 166 - DNA, 2115 bp, Aspergillus nidulans
atgttcatcgccttcgaagctaccaaggacgccaacgcctcaaaagacctcgaatcaggccctcgtaaccccaagagcgtgacgggtcgaaccagtactggtagacgcggcgtcgtacctcgagcttgctcttcctgtcggcgtcgcaaagtcaagtgtaatggcgagaagccgtgtgaggcgtgccgatggtacaagcggcctgaggagtgtacctatccagagtacgaacggctacgaaatatgaaatcgagcccgtcgcctgattaccgcagcaccctgacaaggctcttccccggcacggcgccagagcagcttgtcaatctaccacgcgagaaactgctggaactgatgaccggcagcgcttctcagatgcaagactcgccctccacgacagcctctgtaacgactggggtttccgtgatgccaatcgagagacccagcctggaatcgctgcattccatccccagagacgagctgggcgaaatccctaatgttccgtcagcctcgtccagcggtcagatctctgacgacgtcaacgctctgtcgctcctggctcgaccacctacgtcctatctaggcatctcatcggtgcaggccgccttgaaagccattgcgtggaacctcccagggtacaatttctcaatttctccgacagtcccccggcaacagcccgaagagccactcagtccgctctcgactacgctcgccacgcttcaatttacagagacacagttggtagatgcatattttgctaattttcattcattcgcaccgctcttagacgaggatgcgtttcgcaaaacgcatcgagccggctatcgacaagatgcgcgatggctggcattacgcgacactgtcctagctttgggcagcattatcgctgccgtggacgtcaacgacagaacgcattgtacttatttcgagagtgcaatgagccgtctgaacctgggttcactgggtaatccgagccttgaagttgtacagactttgggcctcatgggaggctggtactgccattacaccagccaaccgaatctcgcatattccctgatgggagcttccctgcggatggcgcttacattgggccttcaccgggagctgtgcgacggccgttccgtgcatgacccggcccaagcggcgcacgaggagttccgacggcgcgtctggtggtcactctgctgtctcgagatctggggtcaggagacgctggggaggcctgggatggacttcttcacggcaagcattacagtcaatacgcctcggttgatcgataaggacaactatatcgagatcgtaccgttgattgagaacgtcgagtttgtgaaggtcgcctcgaaaatccaggaatcgctagctacaccaccggctttgacgcatacagagatgtgcgacctggacacacaactcctgcaatggtggaacaatctgcctccgatcctcagggactccgagccgtaccccgagagcatctattccgtccgcacggtgatgcgatggagattgtatacccaacagatgctcctgtaccgccccagactcttgaaccagaccatgcgccgcattcctttcctcgctgtgcgagccgacgaacgcactgctatccgaaggtgtcgtgaactcgcagagacggtgatcctcgatatcgcccagacgacgagcatgaatcgcatgataggctggaacgctgtctggttcatattccaagcgacaatggttccgctgatctgtctctcgggcatccctgtagacaacgacctggaagcttcggctgactcttgcaaacgccaagtggagactgcaatcctggctcttcagcgaatgagaccttattcacccacggctggacggaccttcgaggtcatctcgaatctttttggtgccatccttcagggtaccggtgaccccccgccggacgcagacagcgacgctcctatggacatggccatgcccgagagagtcccggtggcaaacgactacaatagcgagcaggccccacgcagtcggcctgtcgatgaggcggcgggattcttcgacaacttgccgccggagtacggctataccagttttggcaccccagtcaccaggtgcctggatatgtctatcatcccatga

SEQ ID NO: 167 - DNA, 2214 bp, Aspergillus fumigatus
atgtttcacacctttgagggttttgaaaaccctggtgcctcagctccggctaagggacgggagcgccagcagtccgttgggcggagagtcaccacccttcgggcgtgcacctcatgccggcatcggaaaatcaaatgcgatgacgagtatcggagcgttctggagaggttatttcccagcacctcccccgaggcccttgtcagtctaccccgtgagaagctcctggagctgtcgggtaagggcccgccgcagccacatgcacaacatccggcttctcctgccacctctgcgtcagttgaagcgcacgtttcccccatatccaacgaagatggcaacttggaatcattgcagacgatgccagaagatcccagcgacagccgaaaccagagcaccagtgatattgcgaatgaaatttcagacgatgtaaatgctctatccctctcagctaaacagccatcctcatacctaggcgtgtcatctatacacgctgtcttgaaagtcatcgtctggcttgatccaggatctctctcttatttctctcggacgccagcgagtgctgctccccgagagtcaatgcatgattactcaacatcagccgagcatcagaactggcacatccaatcgtctcagcagcgaccggtcacaccacccaaggctcatatgcaagcgaccgatacgcagctgctcgacgcatacttcacctggttccagccgtttgtgcccatgctggacgaacaagcttttcgcgagacgtacctgtccggacaccgcagagacgaccgctggctcggacttttaaacattgtctttgccttgggaagcatagcagcatgcccgtccgatgacatatctcacaaggtttattaccagcgctctaaaagctatctaagtttggattcattaggatcctcgcacctagaaaccatccagactttggggttgatgggcggttattatctacactatgtcagtgagccaaatctggcttactcactcatgggagctgcgctccgcatggcggccgccttgggtttgcataaggagttctcctacaatcaggatgcgtccaacaaacagaaactttcagccatggatctgaaacgccgaacatggtggtcgttattctgtatggatacatggggtggaatgactctgggtcgacccagcatgggtcgtcttggtcccaccatcacagtgaagctaccaaatcacagagaagctggaaacattctggatatcctccccctgcttgaaaacgtccggttctgcaagattgctactcagatacaagaggttctggctgtcgcaccgttaacgaaacatgccgagatgtctcaactggacaatcagctgttggaatggtacgaaaatctgccctccatcctcaaagaccatgaaccatgctccgaatcgatttcgaacacgcgaaccatcatgcgatggcggtattataaccagcgcatgctcctgtaccggccgaccctgttgagctatgctatgcggcgagttccctacatcgcgctgaggtcggaggaaaggaccgctattgagaaatgcagagaagtggccgacgccaccattcacgatatctcctctaccgcccagtcgcatcaaatgtccggctggaacgctacctggctcatctaccaggcaacaatggttccccttctgggtctgttcctcaacgacgccacagcgagtgatctcagagcatctgtccaatcgtgccagtcgcaggttgagacggcgatgatggtattggcacggatgcagctctccagccccgcagcgaagcggacgctggaagccgtctcgagaatactcgaagccagcaaacgaggctctgatatgggaggcgcagcgagcggtctcgccagtgggagctgcgcgcaggggcgcgaaagcaacatttcgggaatgatgcctggattagtctcagcactgaccgaacccggccggggtgttgcgattgcgaatgacggtggaatggtagaaccaatggcaccgccattcatggacgagacgaccggccagcaactgtgggattttctcagttggagcgattcaaccatcttgtctggattctcggagtttgataacccgaacgacataaagtgcgacggcaatgcgcctggcctctatggcagtcctatgaccgattcaacatattacatgcatcaatccgtgccattttactcgcttggtcaaccataa

SEQ ID NO: 168 - DNA, 2115 bp, Aspergillus fumigatus
atgttccacacctttgcacttcgccacagcaacccgcgcgcagcgacgggagaagaacggcgaggcagacgaccaggattacgagcctgcaaggaatgccgtcgacgcaagatccgctgcacagggacgcatccttgtgagccgtgtctatactacaaaaagccggagctgtgtcgctattcagatcccagagtgccacacatcgggacgcgaggaaatggttcccatgccgatagtcagtatctgtctgttttggagagactgtttccttcagtctcgttgcagtcgcttgcctctctgacgcgcgaggagctcctggatctgttgcgagatagtatacttggctcggatcggcccccttcgcagcctccggagggtgcggaggaccactcacgatcgtctttcgaggcgatgtcaacgggaaatgctgacagcggtgatgtcaatgctgtcaatgacaaggctgatgtatcggatgatgtcaatgcgctctccatggctacgcgtccgccgtccacctacctgggcatctcgtccatcaatgccgtcctcaaggtgatcagctgggtcaatccggagtcaatagctcgaccgttcactacagctcccttgagaaacaagcctcgaccgaaagcgcaagtgtcaagacccccatcaaccgactgccatgcccccgaccaactcatcgacgcctacttcaacttcatccatcccttcatgccgctcctcgacgaaaccgacttccgacagacctacgtatccaacaccaggcgcgacgagcagtggctcgccctcatgaacatggtcctcgccctaggcagcatctccttctaccccagcgatgacaccacgcacatcacgtactgcaagcgcgcgcaccaacacctctccctcgaatccctcggcagcgcacatatcgagaccgtccagaccctcggcatcatggccggccactacctacactatatcagccagccgaacctggcgtacgtgctcatcggagccgcgattcggatggccaccgcgctgggtctccacaaggagaccgcagacacggacgccagcgagagcagaccgctccagtcgtcgtctgtgcccgtcgacctgcgccggcgcatctggtggtcgctctactgcctcgatacatggggctgcatgaccctcggacggccaacgctaggccgcacatcgatggccgtctcgacaaagccgccagcgagcacacccgacaccctcatcctcgtcgaaaacatccgcttctgccagatcgccacccgcgcccaggaagccctcgccgcatcccccctcccgccctacgctcaactccacgacctcgacaccgagctagcagactggtacgcgcagctgccgccgctcctgaaaacgtacgaaccatgcccggactcgatccataccgcccgcaccatcatgcgctggagtctgcataacctgcgcatcctcctctatcgcccattcctgctccggtatgccctccgccgcgtccctgccatcatgctccccagcgacgagcgccccgccatcgagaagtgccagcagctcgcgcgcgacgcgatacgcgatattgccgagacgcaggtgaagagtcccgcggctgcgtggggggtgatctggcacgggttccaggcgagcctggtgccgttgttaaagttgagtatccttgccgcggaggccgacggacacgatgtggacatggagatggtggagtcgtgcagggagcagcttgaggccgccatggcagctattgagcgcgtcgaggcgtggcagcctactgcgcggccgagtctggatcttattgcgggcatctttggcgcgtcgatggcgaggctggagttgatggcagtgtcgacggcctcgtcggatgggcgcacgtctcctgttgccccggagcggggatatccagttgaactacagcccagggtcagggtccaggtcccgcagagcggacctatggcgtatatggagagtgagctaggcgtggtgagtgaggatgtttgggatcatattagttggatgagtcccacggcgtgggatgatgggcaggggcaggccagtgtaatggacttgtggtccacgccggggtggtggcagctttga

SEQ ID NO: 169 - DNA, 2127 bp, Aspergillus niger
atgtatcgatcaagcaggcatgtggagaaactgtcgaccacactcgatgaattcaggggagtgcttgacaagctcttccctggcattccagcggagaccctggtcaacttgcctcgggacaagcttctggagctgacaggcaaggggccttcccagatgcagacgcaagcgccacacccggcatccccagcaacctcggcatcggtagaggctcacgcatcgccagcatccagcgaagacggcaatctcgagtctctacagacaatacctgatcacacaactgatgatcgtgaattgaaaggttctgagctaacgagtaccgtatccgacgacgttaacgctttatctctctcggccaaacagccatcttcctatttgggtgtctcttccatccatgctgtgctaaaggtaatagtatggctggagccgagctctctctctcatttgtctcgcgcacccgccacaggagtccgtcgagaatctgtcatggacattgcatctccagaggcccaggcctggcaggtttttgggtcacagccccatcatggcacgtccacccatagcccactccaggttcccgagactcaactgctcgatgcttacttcacctacttccaaccttttgttccaatgctggacgaacaatattttcgccaaacgtatctttctgcgcgcaggaaagacaagcaatggctcgcgttacttaacattgtctttgctttgggcagcatagcagccaccccggccgacgacatgtcccatcaagcatattatatgcggtctatgagccatttgaatttggaaagccttggatcaccacacgtggagactatccaagctctgggcctcatgggtggctattaccttcactatagcagccaacccaacctcgcgtactccatgatgggagccgcgttgcgcatggcggctgctctggggctacataaggaagtgtcagatggccagtatggcaatggcaggaataggctatcttcagttgaccataaacgtcgggtatggtggtctcttttctgtctggacacgtggggtggcatgaccttgggacggccaagcatgggtcggctgggtccagcaatcaccgttaagctaccacattacagagaaacaggcaatgtgctcgaccttctaccacttttggaaaatgttcgcttttgcaagatcgcgacacagatacaggaggtcctggccgtggcaccgctgacaaaacctcacgaaatggcacatcttgatagccagcttttggaatggtatgataaccttccttatattcttaaagaccatgagccatgctctgagtcgattgcgatcacgagaaccgtcatgaagtggcgctattacaaccaacgcatgctcttgtatcgccccaccctgctcagctatgccatgcgccgcgtaccatacattgtgctcaggtctgaagaaaggacggcaattgaaagatgtagggagattgccgaggctaccatacaagatgtagccgccaaggcacaattccatcagatgtcaggctggaacgcagtatggcttatcttccaggctgctatggtccctcttctaggcttgtttctcaatgatggtacggttgatgatccaagagcgacagctgaagcgtgccaggctcaagtggaaacaacaatgcttgtcctggagcgcttggaaccttggagtccagccgccaaatcaacgctcgaggctgtttcccgaatatttgaggctggtaaacgtggccccagcgtcatcggggaagcccacagcattaacagcggtagctgtgtaacgtctactgaagagactcttggcgcagttcctggggtatctccgatgcaagtcgactttggtcgcgctattccacacgacagtggatttgtcgacccatttgaaccccagtttatcaatgattctgctggacagtatctatgggactttcttagttggagcgatagcaacttgttgcagggtttggctgatattgacaatgtcaacaatggaccactgtttccccaggaggagagaaatgcaaagtatggatccagcgacactgcgttttttggaggccaattgggagattcaacattttttatcaattcagggccgtccttctactag

SEQ ID NO: 170 - DNA, 2931 bp, Leptosphaeria maculans
atgcagcccagtcgcatgttgcaaactgccgccacgtacgacgcaggctcaacctcgacccggactctggatgacttcgttgtgctggtgttcatgccggcagaagcacctcgcgaagaagagattgcgtgtgcgcggattgtaccgtacgtatcggggacctacacaatactagcagtgctggcgcatgatgaggccagccatgtttcgttgtttcgtggccatgaatcgccatcttccaagggccgttcttctggagaccttctcgaacgcgccgccaacatgacatatgctgattttcaatgtcaatctcgcttggctttgcgaggcaactcttcccgtccgcccgtctccaacggtcgcctgtctctgctcgtccaccaggcttatgacgatactgctccggctctgggaacgagaggcgactttcctctgacaatacttcggcctgcagatgacatgcccactaccaaaactctaccggccgctctgatatatcaaccctgcatcgttggcatcgccaatttgaccgaacaagagaaggtctgggtagtcgacacaggcgacttcgacacgtcgtcttgcagcacgagtcaacacgacatgttccacactttccagtcctctgccgcaatgcggtctcccgatgcagacatagatgcttcaggcaaaccatcgcgccccccagggtcacggcgcatatccaccagcaacgcgtgcgtcgaatgcaggaggcgcaagattcgctgcgatggctcgcaaccctgtgggcaatgccagtggtaccagcaccccgaggcatgtgggtattcgaaacctgcgcagagagtggtacccagcagaaaactagttgacaagctgtccaacaacatcgagcagtacaaagccgtcttgacgaagctgtacggaggcaggaatctcgagtcattggcaaatctgcccagagaagagctattggaactggccctctcctcaccctccatcacattgacgacatccccttccacgacagaatccgtagccctgtcagacgtccaggcgggatcggatggggctgagagtctggaggcgcttgaacaagctccacccgaagatccttactgggatgaggcacggaagcaccagctccgtgtccaaggcatttccgacgatgtcaatgggctatccatgtcagtcgaccgcctctcgtcctatgttggaatatcttccattacagcggcactcaaagtgattgtaagatgcgctccacaagcccgcctgttgattgcgcacaacagccaggaaaccgcgctgccgagccgtgcggggtcaccgccgcccgaacttgcggacaataacccgcttgctgttccatcagcacagcacggccagcaacttattgaagcgtttttcgaccgggtccaccctttctttcccatgatagatgagcgcaagttctggaacacgtacttgtatggtgatcgcaaagactccgcatggctcggcttgctcaacacagtctttgctttgggctcactttcctcgtcgactgcagacaacgaggcccactatgtctacttcacccgcgcgagacagcatgtctctctggaatcttttggaagcgggaacctcgaggtcctgcagacgttggcgattatgagtgggtactatatgcattatctaaacagaccgaatgaggcacattctctgatgggtggcaccctgcgtatggctactgctctgggcctgcaccgtgaatactctgaacgcagtggttcaagtcggaagttcacagcggctggtgaggaggactcgatctctccagaaatgcggcgacgcatatggtggagcttgttctgtcttgattcctgggcttctaccaccactggccgcccatctttgggtaggatgggaccttcaatcacagtgatgagacctggcaccgcgcccaatgcggtacaaacgattccgccaccagacagccctcagtacatcgaacaactcaaaattctccccctaatccacgcttctgcattctgtcagatagccactcggatacaagatcgtctcgtggaaacacctttactctccttggctgagactgcagctttcgatatgcaaatcctcaagtggcacgaggaactaccctcaattctctctgatctcaacgaaccatgtccagactttctgcgccgagttcgaactgtcatgaaatggcgctttcaaaatattcgtcttgtgctccataggcccgtgttacttacaacggccttgcgacgcagctcttggaactctctaagcccggaagaaaaggtggcggttggaaagtgtcgtatgatcgcggccaagacaatccaggagctgagcaaggagtgcatggctgacctgatcagtggctggaacgcggtatggttttgcttccaggcctgtatggtccctcttgtctcgctgttcagcgactgttctataccggaagaggtgaagaagtggaatgaaagcctggaaaccgccttgcaattctttgaaacggccaaagactggagtatcgctgccaagcgaagtggggacgctgtcacaaggctgtatgccgcatacaagacctatgcatctacaatgctttcacaaccacaagctcccatgcagacggtccagcctcattaccaggattccaacaactttgcactcccaggcaccgtgactacaagcagtatgctgaatacacatcaaatttattcccaagcccagcccgcattccaatacaacccgtcaacaccaacgtgggcaaatgcaaatgatccaaccattctgaacaacctctgggacgacatgatgtgggacacaaatctcccggacatgctggaaacaccattcgggctgaacaacgactgggagtatgcatcaacggcgcaagactcgggctcaggtggggcatgctggatgcatgggaattga

SEQ ID NO: 171 - DNA, 2214 bp, Aspergillus fumigatus
atgtttcacacctttgagggttttgaaaaccctggtgcctcagctccggctaagggacgggagcgccagcagtccgttgggcggagagtcaccacccttcgggcgtgcacctcatgccggcatcggaaaatcaaatgcgatgacgagtatcggagcgttctggagaggttatttcccagcacctcccccgaggcccttgtcagtctaccccgtgagaagctcctggagctgtcgggtaagggcccgccgcagccacatgcacaacatccggcttctcctgccacctctgcgtcagttgaagcgcacgtttcccccatatccaacgaagatggcaacttggaatcattgcagacgatgccagaagatcccagcgacagccgaaaccagagcaccagtgatattgcgaatgaaatttcagacgatgtaaatgctctatccctctcagctaaacagccatcctcatacctaggcgtgtcatctatacacgctgtcttgaaagtcatcgtctggcttgatccaggatctctctcttatttctctcggacgccagcgagtgctgctccccgagagtcaatgcatgattactcaacatcagccgagcatcagaactggcacatccaatcgtctcagcagcgaccggtcacaccacccaaggctcatatgcaagcgaccgatacgcagctgctcgacgcatacttcacctggttccagccgtttgtgcccatgctggacgaacaagcttttcgcgagacgtacctgtccggacaccgcagagacgaccgctggctcggacttttaaacattgtctttgccttgggaagcatagcagcatgcccgtccgatgacatatctcacaaggtttattaccagcgctctaaaagctatctaagtttggattcattaggatcctcgcacctagaaaccatccagactttggggttgatgggcggttattatctacactatgtcagtgagccaaatctggcttactcactcatgggagctgcgctccgcatggcggccgccttgggtttgcataaggagttctcctacaatcaggatgcgtccaacaaacagaaactttcagccatggatctgaaacgccgaacatggtggtcgttattctgtatggatacatggggtggaatgactctgggtcgacccagcatgggtcgtcttggtcccaccatcacagtgaagctaccaaatcacagagaagctggaaacattctggatatcctccccctgcttgaaaacgtccggttctgcaagattgctactcagatacaagaggttctggctgtcgcaccgttaacgaaacatgccgagatgtctcaactggacaatcagctgttggaatggtacgaaaatctgccctccatcctcaaagaccatgaaccatgctccgaatcgatttcgaacacgcgaaccatcatgcgatggcggtattataaccagcgcatgctcctgtaccggccgaccctgttgagctatgctatgcggcgagttccctacatcgcgctgaggtcggaggaaaggaccgctattgagaaatgcagagaagtggccgacgccaccattcacgatatctcctctaccgcccagtcgcatcaaatgtccggctggaacgctacctggctcatctaccaggcaacaatggttccccttctgggtctgttcctcaacgacgccacagcgagtgatcccagagcatctgtccaatcgtgccagtcgcaggttgagacggcgatgatggtattggcacggatgcagctctccagccccgcagcgaagcggacgctggaagccgtctcgagaatactcgaagccagcaaacgaggctctgatatgggaggcgcagcgagcggtctcgccagtgggagctgcgcgcaggggcgcgaaagcaacatttcgggaatgatgcctggattagtctcagcactgaccgaacccggccggggtgttgcgattgcgaatgacggtggaatggtagaaccaatggcaccgccattcatggacgagacgaccggccagcaactgtgggattttctcagttggagcgattcaaccatcttgtctggattctcggagtttgataacccgaacgacataaagtgcgacggcaatgcgcctggcctctatggcagtcctatgaccgattcaacatattacatgcatcaatccgtgccattttactcgcttggtcaaccataa

SEQ ID NO: 172 - DNA, 2115 bp, Aspergillus fumigatus
atgttccacacctttgcacttcgccacagcaacccgcgcgcagcgacgggagaagaacggcgaggcagacgaccaggattacgagcctgcaaggaatgccgtcgacgcaagatccgctgcacagggacgcatccttgtgagccgtgtctatactacaaaaagccggagctgtgtcgctattcagatcccagagtgccacacatcgggacgcgaggaaatggttcccatgccgatagtcagtatctgtctgttttggagagactgtttccttcagtctcgttgcagtcgcttgcctctctgacgcgcgaggagctcctggatctgttgcgagatagtatacttggctcggatcggcccccttcgcagcctccggagggtgcggaggaccactcacgatcgtctttcgaggcgatgtcaacgggaaatgctgacagcggtgatgtcaatgctgtcaatgacaaggctgatgtatcggatgatgtcaatgcgctctccatggctacgcgtccgccgtccacctacctgggcatctcgtccatcaatgccgtcctcaaggtgatcagctgggtcaatccggagtcaatagctcgaccgttcactacagctcccttgagaaacaagcctcgaccgaaagcgcaagtgtcaagacccccatcaaccgactgccatgcccccgaccaactcatcgacgcctacttcaacttcatccatcccttcatgccgctcctcgacgaaaccgacttccgacagacctacgtatccaacaccaggcgcgacgagcagtggctcgccctcatgaacatggtcctcgccctaggcagcatctccttctaccccagcgatgacaccacgcacatcacgtactgcaagcgcgcgcgccaacacctctccctcgaatccctcggcagcgcacatatcgagaccgtccagaccctcggcatcatggccggccactacctacactatatcagccagccgaacctggcgtacgtgctcatcggagccgcgattcggatggccaccgcgctgggtctccacaaggagaccgcagacacggacgccagcgagagcagaccgctccagtcgtcgtctgtgcccgtcgacctgcgccggcgcatctggtggtcgctctactgcctcgatacatggggctgcatgaccctcggacggccaacgctaggccgcacatcgatggccgtctcgacaaagccgccagcgagcacacccgacaccctcatcctcgtcgaaaacatccgcttctgccagatcgccacccgcgcccaggaagccctcgccgcatcccccctcccgccctacgctcaactccacgacctcgacaccgagctagcagactggtacgcgcagctgccgccgctcctgaaaacgtacgaaccatgcccggactcgatccataccgcccgcaccatcatgcgctggagtctgcataacctgcgcatcctcctctatcgcccattcctgctccggtatgccctccgccgcgtccctgccatcatgctccccagcgacgagcgccccgccatcgagaagtgccagcagctcgcgcgcgacgcgatacgcgatattgccgagacgcaggtgaagagtcccgcggctgcgtggggggtgatctggcacgggttccaggcgagcctggtgccgttgttaaagttgagtatccttgccgcggaggccgacggacacgatgtggacatggagatggtggagtcgtgcagggagcagcttgaggccgccatggcagctattgagcgcgtcgaggcgtggcagcctactgcgcggccgagtctggatcttattgcgggcatctttggcgcgtcgatggcgaggctggagttgatggcagtgtcgacggcctcgtcggatgggcgcacgtctcctgttgccccggagcggggatatccagttgaactacagcccagggtcagggtccaggtcccgcagagcggacctatggcgtatatggagagtgagctaggcgtggtgagtgaggatgtttgggatcatattagttggatgagtcccacggcgtgggatgatgggcaggggcaggccagtgtaatggacttgtggtccacgccggggtggtggcagctttga

SEQ ID NO: 173 - DNA, 2226 bp, Glomerella graminicola
atgttccactctttcgacagtcgccggagcccctcggcatcggcagccgccgctccgactctgccccggaaagtcaaccgctcgtgccaggagtgcacgagacggaaagtcaaatgcgacggtggacacccttgcgccagttgccagtactacaaagtggcagactcgtgcgagtataggcagcggagcagacggcacgctgtgagcaggagcactcttgaaaagactgcagagaagctccgcgaccagtcccgtgtcctgcaggaactcttccccgacgtctccgtggacgacctgctcggcaagagtcgggcggaactgctcgcgttgctaccacgagactcgctctctggtacacgtcccgccgttccacaggccggcctcttaccagctggtgtcgtctcaaccgctgctccggaagaagacgggaacgaggacgaggacgatgttccagacgacccgacgcagctctccgagagcggggaagccgccaacgacaggcgctgggaggagtccgcgcaccagcccaccaccatccgagccagcgacgacatcaacgccgtgagcctggcgacggaccagcaccatagttcctacctcggcgtcacctctgttagcgccgtcctgagagccatcttccgtctctgccccgccgcgaaagagcacacggcccagcgcgtcaagacgtggaacgacgcccaaaatcaatcccagctgctgccgtcgctgtcccccgccggggccggggccggccagaaccctctgcgcgagcggcgctgcatcgtgttctactttgaccacgtccaccccatcaccccgattctcaacgaggacgacttccggcggacccttgcctcgggggcccgccacgacggctcttggctggccctcctcaacatggtcttcactctgggctccgtcgcttccggcagcgactcgctgcacctacactactacaagcaggcacgcgcccacctcgacatagacttcctcggctccggcaacatggagagcctccaggccctctgcctgttaggcggctactacctccactaccgcaactcccccaacatggcctacgccgtcctcggcgccgcccaccgcgtcgccatagccctcggcctgcatcgggaacccgcccctcgcagccgcatcgccgacgaacgccccgtgagcgatgcggagcgcgatacccgcgtctcccgcgccgagacacgccgccgcacctggtggggcctgttctgtctcgacacctgggcgagcatgaccctgggccgtccgacctgcggccgctgggacggtagtactatggacacgctcctgccggcgtcgttgttccctgacgaccacgtcgccgcatcgctgcgggccagctgcatgttctgtcacatatgtgaccggatccagcaccgcttcgcccagcacgcccgcttgtccgcccaggaggccttggccttcgaccgcgagctcagggagtggcacgcctccttgcccgagtacctgcgtgacccggcgaactccccgccccggctggcgatggcccgcgagttcatgcgcaaccgttacttgagcgtgcggctcatcttgtcacgctgcttcctgttgtatctcgcccaaagccacggcctcagacgcggtgccgcgtctgtctccagcatcgctgagccctctgccgaagatatgatgctagtcgacatatgccgctctgtcgctttggaggccatcgatgcaataacgctctactggatgcccaaccgcatccacgtctggaactcggcctggtacctgttccaggcctgcatggttccgctgctgtccatcgccatcgagactaggcaccgccactcgtcctgccagcaggagagaccggccgtccgcccgataccttcactggccactgccggcatgcctccggtagcacccctggccacatggtgcgcgggcctcaccaaggccctcgaggtcttcgccgagatgcgcccctggatgcgcacctcggactacaccccggaaatcgtcgcggcgctctacgaggctgtcaccgccgagattgaagaacccggagccgccgtcgggcccgccacccgcacaccctcagccacgacggacggcagcatggacctgttcgagtggtgcgacgagcagctcgcggaactggactggggcacatacctcggcgtcggcggcgaagatgggatgcatcagcgcatgtttgccttcttctga

SEQ ID NO: 174 - DNA, 2256 bp, Glomerella graminicola
atggccccgtcgattccagtttccactcaaggtggaatgttccatacctttcagggagtaacgccgcaaaaacaaacgtccgatagccaggaaagcggaaaatccgccggctccaacacttccaagagaatcaccacacctcatgcgtgtgctgaatgcaaaagacgaaagatccgctgtgatggccaacagccgtgcggtcagtgtctttcaagccgggcccccaagcgctgcttttacgacaaacaccgacagcgcgtcatcccttcaagaaagaccctcgaagccctgtcacagtcccttgaggaatgccggtccatcttgaaacggctgtttcctaaccaagacattcaatcgctgctcccgctctgccgccaggaccttcttagtctgcttgaacgccctgtacttgttacggcgactgcgcttccatcaccgcctctgaacaattcccctctctcacaagagctggaatctcctgtttgctccggctccgagcgaggcttctccagcctcgagttgatgcccggccgagatactgagtgggacgaagagcgccgcgcacgcgaccccatccccatcgaggccgatgacgtgaatgcgctttcgctatctgtggaccggcaatcgtcatatcttggcgcctcttcgataaaagcagcactgatgtgcctgatgaaggtgcagcctgcactccgaaactcgctcaccacgccgctccacagcgccgaagtcatgcataacttcccaagtttgcgtcagaagagcgcggtaaccaaggatacgcagcgcgttccctggtcgtggaaaggccagacgctgatcgatgcctacttcaagcgcatccatgtattcgtccccatgctcgacgaggccgcctttcgtgccgattatttggaaggccaacgatttgacggcccttggctcgctcttctgaatatgatattcgccatgggcagtatcgtggccatgaagtcagatgactacaaccacatcaactactacaacagggccatggaatatctgccaattgacgcttttggcagtagtcacattgaaatggttcaggctttggcactgattgggggctactatctccactacatcaacaggccgaacatggccaatgctgttctcggtgctgccatcaggatggctagcgcccttggacttcaccgagagagcctagctcaaggttcaagtgacgtggtcgccgccgagacccgtcgccgtacttggtggagtctgttctgcctcgacacttgggcaacaacaacaatggggcgaccctcgtttggtcgatggggccctgcaatcaacatcaggccgcccgagttcggcgtcaaccagacccgagactcttctcagcacgcgggcatcttgccactgattgagaacatcaaattctgcaagattgccacccagatccaagacatgctggcgatttcgccccttctgcgtacagaggatcgttgcaaccttgacggtcagctggtcaactggtacagcagcctcccatggctcctcaggacgaccgacccctgcgctgagcctctgtacattgcgaggtgcgtcatgaagtggcgatatcagaacctacgaatgctgctcaaccggccggttctcctcagcttggctagcaacggctccctctcacaggttggagagcaagatattacggccatcgagacgtgtcgcgaaattgccaagcacaccattgaggacattgcaagggaatggactcgcaaccaaatgtcgggatggaacgctgtgtggtttctctaccaggctgccatgatccctctggtcagtgtgttctgggagtggaacagtccacgtgttcccgactggcaccagcagatcgagacaatcattgatctgctagaggctatggaagactggtcattggcagcgaaacgtagccgagaagtagtgtggcgaatgtatgaagcctctcgacagccatccgtgcggtcagagagtcctctgcaagggatgagcagcgatcaaggcttattgttggcggaatcagaactgcacatgtcacccattggcctggagccggaagggatgggcatgatgggcatgcttgatcagcatggtctatgggatctggacggcatgtattggggccaaagccccgaccagagtgtggactttaccccctacaccgtcaacgagcaaatgatgcacatggactatggtatgatgggcagtcagactgcaacaatagggggtgacttcttcatccactag

SEQ ID NO: 175 - DNA, 1881 bp, Coccidioides posadasii
atgcccgatgattccaccgagagtcgtacatgccggagcccagatctcgtcgccgctgtgtccgacgatgtcaacgcgttgtccttatcaacaaaacggccctcaacatacttggggatatcttcggtgaatgctgttatgcgggtaataatgtggattgatcccgagagctctcagcatttctccagggctcccgatccgcaacccctcccaaaacgggagaagcaacctctcccggataactgctcttggtccttgcagcccccaccttccacggctgggcatctggaagtaaatcccatggaacttaccaacgcgtacttcgcatacttccactccttcgctccattgctggatgagcacttattccgcgaaactgtcctggttcgtaaaaggtccgatccgcgttggctagcactccaaaatattgtttttgcacttggaagtattgctgcatacacggccgatgatacatcccacgagtcctactatctaaaagctagacactatttgagtttggatacccttgggaatccgcatttagagaccatccagacccttgccttaatgggaggccattacttacattatatgagccaacccaaccttgcacattctcttatggcagttgctctgcgtatggccactgttctaggtctgcataaagaattcattggaaatcaggaagctgctagtcaaaacagccaaagaaaattctctgtcgatttacgaagaaggatctggtggtctctcttctgccttgacacttggggctatatgacgttgggtagaccaagtatgggacggtggggccctggaattacagccaaactcccacataaccatggaaacaaggaacttgccttttatgcgctttccttagtagaaaacactcggttttgcaaaatagctactcaggtgggagacgctcttgcagcttctccgattgtcagctatcaagaaatggtcagtctcgataatcagttggtcgaatggtatgacaatcttcctccgctcctaaaggatcatgaacccagtgcagatccggtttctacaacgcgaaccgtgatgcgatggcggtatcaaagccagcgtattcttcttcatcgtcctgtcttgctaagctacgcgatgcgtcgtatcccctatgttgcactcagaacagaagagagatatgctattgaaagatgcaggatggtcgctaatgaaacaattcgggatgtcgcttcaactactcgcttgaaccaaatgacaggatggaatgctgtttggctcctcttccaagccacactagttccgctccttgggctttttattgctgatggaaccgccacccatgcgcacgcaacgtcggatagctgcagaaaccaagttgaaacggcgattgttgcccttgagcgcttggagaactggagtccaactgccaagagaacgttggaggtagtctctcgaatcctagaaactagccagcgaccacgccacaccagcgtcggcagctgtacatctggaagcgacacccacacagccggcatgagtgatcagtctgccaccgcttcatcggaaacatcaaacaccgcgccttctattcacactatggaccaaacagccgtccttagcaatgctgcgttccctagttaccagaatattgcaccatatatacagccatcaccgcagcaaatgttggattatattacatggggggataataacatctggtcgagcgtccaagaggatttttatactcaacaaccccccgctgtggggatgtttggccagggtcaacagtaccttaagcctcttgatcatgaacctcccgcggttggagaaagggctggagtgtatgataacggattagagactccgaatattgtacggttttag

SEQ ID NO: 176 - DNA, 1956 bp, Metarhizium anisopliae
atgcagactcttgcgagttccgccaacgctccaggcggaatgcccacttttgacaagacatccgagcagctcaaattgcaatccaaggttctggagactctctttcccggttccaatctgaaagatctcttggaaaagagtcaaagtgagctcctcgagctactcagcgtaaaccatgtctctccacgcagcaaggtgcatcaactgcctcctcatatgcccatcacgccaggtccaccccccgttcttcctcaaagacgagaacgagaagaagatgaccaatttgcctcgggctcacctgctcaggggtccgcctccgtgtcggaaaatgaagaagcggccgaggaacgccaatgggacgaatctctcgaccaacctgctaccgttgccagtgacgatatcaacgccatcggattggctgcagacaatcaccatgcgcgctcttatctcggcgtaacatccatgagcgccgtattcagaaccatatttcaattgtgccctgccgccaaggagcacaccaacaaatgtgccagatcgctggctgcagtgccctcaccagtatatccgacagtgcctgttaccggcagagacccagcactgagtgttctgcgggaacagcgttttattgacttttatttcgaacatatccatccccttactccactattagatgaacaagactttcgaagtcagtacgcatctggcactcgtcgggatgggtcgtggatgggactcttgaacatggtctttgctttgggatcgatagcttctggaagcgagggtttgcacgagcagtattatcgggaagcccgctcatttacaggattggatagtctagggtctggcaaccttgaaagtctgcaggccctatgtctcctcggcggatactacttacactatcggaactcgcccaacatggcctatggcatcctcggtacagcccagcgggtagccattgcgctcggtctacaccgtgaaccccgcagggccatggagacaccagaccctggcgaaatggaatcatgtcgaaggcgtgttgaaaccagaagacgaacatggtggtcctttttctgcctcgacacgtgggcttgcatgacccaaggtcgccctacatgcggtcgatgggaaagcagcaccatggacacatactttccatcgtgtctctacccagatgaccaagaggctacattgctccgagccaacattgagttctgtctaatcttcgaacgggcccagcatcgctacgcccagttcagccgtctctccaaccaggagattctagccctcgacgccgaactgcaaacgtggtacaagagcctccctcaagaaacaaaacaagttgacaatgctcctcaaaggttccggtttgcccgagagctattaaaaacgagatactacaacgcccggatcattcttgcgcgatcccttatactctacatggctcacgacttgaagcgtaaacccgcagaacttctccccgagcaaggccacattctcgatcactgttgctccattgccgcagaggcaatcgactccacagcacgatactggtccccgaaccgcattcacgtgtggcattccgcatggtatctgttccaggcatgtaccgtgccgctgcttagcattgcaatcaacagaaatatggaacagcgtcaacagaaacaagtatcatcaccatcatcagacagagtcgtctcttggcagacgagcttggcaaaagcgctggacacatttgccgaaatgcggccatggatgcgaacatctgatcgatccccagatatagtgtctgccttgtacgaagccctgacagctgctggggaagtagacggccaaacgccttctgcgacggacgggagcttggatctgtttggctggtgtgatgatcagcttacagagttggattggagagtgtttctaggtgatgaaggcttggccagggggatgtatccagtgtga

SEQ ID NO: 177 - DNA, 2505 bp, Neurospora tetrasperma
atggcaccatcaatttcgatacctacacaaggcggcatgtttcacacattccaaggagtaacaccacgaaagccggccgttgactctcgagatagtgttaagtccaatggtagtggggcagccaagaggatcactactcctcatgcttgtgctgagtgtaaaagacgcaagattcgatgtgatggtcaacaaccatgtggccaatgtctctcaagccgagcaccgaaacgttgtttctatgacaagcaccgccaaagggtgatcccatcacgcaagacactcgaagccctctcccagtccctcgaagaatgccgatcgattttgaagcgactgtatcctcaccaagaagtccacgccttacttcccttgtccaggcaagaactcctcaacctcctagatcgacccgtcccggacagcacagcgaacggactaccgtcacctcctttaaacacaacaccgatggccgactcagagacaccaaccaagtctgaaaacatattggaacagattccgactcgggatacagaatgggacgaggaacgccgggagagggaccacatccctgtagaggcggacgatatcaacgcgctgtcactctcggtggacagacaagcttcttttcttggagcctcgtccatcaaggctgccctcatggttatgctcaaggttcaaccaggcttgaggagctccttggccgccccgctcaacagtatcgagatttctcataacttcccggccatcagacagaaatcatcgactcagaaagatccccagcggatcccatggtcatggaagggacagacacttatcgatgcctacttcaagcgagtccacgtcttcatcccaatgctcgacgaaacaactttccgtgccgattaccttgaaggtcaacgatttgacgcaccgtggttagccttgttgaacatggtattcgccatgggtagcattgtggcaatgaagtcggacgattacaaccacgtcaactattacaaccgcgccatggagcatcttcccatggattcctttggcagcagccatatcgagactgtccaagcattggcactcatcggcggttactatcttcactatattaaccgacccaacatggccaacgctgttttgggtgccgccatccgcatggcgagcgctctcggtcttcaccgtgagagtcttgcccaaggaggaagtgatatggtcgctgccgagaccaggagacgcacatggtgggctcttttctgcctcgacacgtgggccacgacaaccatgggacgtccctcttttggccgttggggacccgccatcaacattcggcctcccgagttcggtgtgaatgccggccgggactcgtctcaacacgcgggtattctccccatgattgaaaacgtcaagttctgcaaaatcgccactcagatccaagacatgctcgccatttctcctttgctgcgtaccgaggaccgctgcaatctggacgggcagctcgttgtctggtacgaaaacctaccttggctcctgcgcacgaccgacccatgcgctgagccgctctacatggcccgctgcatcatgaaatggcggtatcagaaccttcgtatgcttcttcatcgcccagtcctcctctccatggcctcatcaggtcttaacccacatactcaggcctgtgactcggatctcgccgccattgagacgtgccgagagcttgctgcggcgaccattgaggacattggtcgtgaatggacacgtaaccagatgtccggctggaacgcagtgtggtttctctaccaggctgccatggttcctcttgtctctgtcttttggcaatggggcaaccctcgtgtccctgagtggctcaagcagattgaggcggtattggagctccttgaggccatggaagagtggtcactcgctgctcgcaggagccgggaggtggttcttcgcatgtacgaggccagcagagtcatccaggcacagggtgccgcagcgcaccaactacagcagaggggatcgcagagccctcattctctcaacagcactactgcgtccttgggcagcatgcacatcaacaatgacttgctcatggggtcaccgggttcggcggagctctacatgactcccatcgacctggagcccgtcgaaggcttgggcatgacgggtgtgctggaccacggcgggatgtgggatctcgacggcatgctctggggtcccagtccaagcccgtcggttcaccatggtcaccactcgactcacccggatgatgcggtacccacggtggcggagtacgctgcagcgttcccgacggctgatgtagtagatgggtttctgcaacatcactcggctatggagtttgggaacatgatgggtcaccaccaccatgcaggtgcacatgctggccagggtcagtttggagttgggctggtagcccggggttatgcacagttggcgcgacgcaggcttgaaggaccgaaataccaccacatacgatggctggatgcggccaccggccttacctag

SEQ ID NO: 178 - DNA, 2343 bp, Mycosphaerella graminicola
atgtaccacacctttcaagctgcgccgtcctttcctgcgagtggagacggtagcaaaggaccccgaccacctggtagctcttcatcgaggcgaatctccactacgaatgcatgcatcgagtgtcgacgacgtaagatccgctgtgatggcaatcagccttgcggccagtgtaattggtatcagcatccggagctatgcgcgtactcgaagccagcacaaagagtcatcccgtcgcgaaaactggtcgagagacttcaatcccaagtcgaacaataccactcgctcttcgctcgactgttccccggcaaggaactggagaacatccttacgatgtcgagagaaggcctcgtcaacctagctgtgaccctgccagcggccaaactctctccaccttctgcagaagcccgggaccggcatcaagtgaagtcagagacagtcgaatcagagacagccgacagtcttgaagctctcgagcaggcccccgagcaggactccacatctggcgaatcgagaaagctccacgcgaagatacaggccatctctgacgatgtcaatggactgtcgctgtcaatcgacaaagcttcatcatacacgggcgtttcctccatcaacgcggcgatgaaggttatcctcaagacagcgcctttcgcttgggctttcatttcgcagccttccgcacaaacatccaacccaagtcgcgctactactccaccaccacatgtgcgagatccggacccatattacttgccttccgcggacgtcggcgaaaagctcattgaatcatatttcaaatatgtccacgtacagatgccaatggtggacgaggaacagtttcgacatggctatctgtacggaacacgtagagatccggcctggctgtcactgctgaacatggtgtttgctctcgggtccttagctagttcgacatgcgacaatgaggaacacattgctttcttccagcgagcgaggaaacatctcattgcagaaagctttgcaagcagtagtctgttcgtgctccaagcatttggtcttctgtcaggatactaccttcattggctgaacagaccaaacgaagcaatcgcgatcatgggtgggactctccgcatggcgactgcgctcggtttacatagagagtatggccatggaaagcccgacaaaggcaccggtggagagatatcggcagatatcagaagacggacttggtggacactctacgttctcgactctttgggcagtctcagcaccggaagaccatcccttggtcggagcggaccaggaatcacgactgaagttccaaggatacccgagcagatgaacaatgctcaatacctggcatctctgcgattgctaccgatcatccacaacatttccttttgtaagatcgcaacaaaagtgcaagatcaattggccgcgcgaacattgattgaattcggcgagctgttcgcgatcgatgcggagttggagaaatggcgtgaggacatgcctccaattctgcgagatcgggactggacttcatgtccagaaatgctgaagatcccacgcgcggtcatgtattggcggtatcagaatttacgaattctaatgcatcgaccagtccttctcgcagccgcgcttcgaaagactccatttgccaatatgaaagatgacgaaaggctggctgtcagccgatgccgattggtcgctgggcagtccatctacgatattgacgcgagctgtccggagaatctcatcgccggttggaacgccgtgtggatggtctatcaggcggtgatggtacccctcgtctctctcgaaggctcagctccgttgccagggagcgacgatgatgtcgaaaagtggaagagtgaaatcgaaacggcgatcgcattcttcgaccgcatgaatcagtggtcagtggcggccaggaaaagcagagacgttgtacaacgtctctataatgctacaagtttcatcgatcagcccagcgctcagctgcaccagaaggtgcagaaccgagaacagtcggcgctgccgtcgacggggttgcaacagcaaagcaaaacaatccagcctgcagaggtcgacttttcagctggacggccgattccccttgacccgtcggagtaccagccgcaagaaaacagcgcaaggcagggatgggacgtgaccacgagtagcggagcggcagtcataccggacgagttcttttggaacgacatgatgtgggatacgttgcctcaaaatatgccagatctgccgccgaatttgggcgagggtattgatgtcgtggattggtggcagaatggatatgacactggcccagacgctcagtcctggagccagtggccacaagatggcacgtga

SEQ ID NO: 179 - DNA, 2307 bp, Neurospora crassa
atggatgaggaccgtccaaggaagcgcgtgcgcgtttccattgcctgtcacaactgccgaaatcgcaagtcacggtgtgatggccaacatcccagctgtggtcgatgtaaagagctcgacgcaccctgtgtctatgacgagccaccggcaccacatcaccgcccaaggtcaagcaccacagacactcctccttcggacatcctttccaggttgagtgctcttgaagaccgaatcaatgctagaggtactgaagccagccgtcaacatgctacccaggacgacggcgacgacatcgatgcccaagaagacacgcgcgagtctaatggcagctcgagcaatggaccgctggatccgcctacgatgacagggctcccacgttcacaccaggaaaatgtccatgtcgatggcatgggcgaggttcaactgactgatgatggagagaattgcacatattttggtccttcttccaatgttgccttggtacgccaactttcgctagccttgactcgggctcaaagccaaacctctcgctcgcgagctatgccgacctctgcaacttcactcgcatcttcaaggtattcgtcacttcaacagccgcgttcagagagcggacgacaagatcccttaaatggcggagtcaaagctggatccagacctggccatcatgtccctcccgaaccagaagccaccaacatcattcacgaatacttcagcaccataggccttttcttccccgtcattcatcaagactcattcatgagcacctacaacgacctgcggaagaaagggttcatgggcgctcgccgcgtgtggctggctctgctctacatgatcattgccaccgtgtaccgtaccaattctccctctactccctccgagacatcggccgaaacctcggaaagatactttcagtgggccaaggacctggtcatgccacagttcctgatctcgtccagtttagaaaccgtacaactcctgtgcctcatgatcgagtatcttcatgggtcttcccaatcagcccagctctggaccttacactcgttggccgtcaagtccgctttgcaaattgggttgcactcagccgatgcctctcgacacttgacccttctcgagcgtgagatgcgtaagcgaacgtggttcttgatttttatgaacgataacaacctgagcgccaaattcggtcggcccatgaccatccctccctctcttcagaaacgactggaacccccactagacatcaacgaacattttcccaccatgtacgcaagccgagccgttatcgccacgagcgtagatgcctttaaatgcggtgtccaactctcacatatcacatgtcaattggtatcccagctatacgacgacaacgcaggcggcagctccctcaaccacgtcaacaccttcgacacccttcgtttggcctttgatttctcatggaagttatcccaatggcaccagtctgtaccaccagacttacggcctcaaaacctaactacggaaactcctcctcctgtccttgaatcatcatcatcatcatcatcaccaagcatcgaagcccaacgtctaagagccgttctcggccttcggtactacggtttatgcaccctggtcgagcgtccagttctgctaaagtttctcggattccagccggaacctgggcatgggcagggtgacgtcgacacgaacgtggcactactgcgcgagtccggtgtagtatccctgcggagatgtatacgtgcctgcagagaatgtatagcgcttgcaaaagcgattgtggaccggtggcagaaccagaaggtgctgctttcgggagcttggtggttgactgcttatcatgctttcggcgcctccctaactctctacaccgtcctccttattgccggcacaaagccctccttctccaacctcctcagtgactccgaactcaccacggtgcgctccgccctcagcgacgccgtcgacttactctcccgcttcggcgaaaacagcctcgtcatttcgcggtgccacgattgtctggtgaactttctgcgtgcttatgacttggttgtggtggagcagcagcggcagcagaagcaacaacaggaatcacaatcgacaacagtagcagcaactgtgcagaccagtagaaactctgatcacacttcttcttctcaatcgttgccgccgcaggggcaagggcagggggtgcatgtgaatgtgataggggatggtaacggcgtgtcattgacgtcgtcgtcgtcgtcgtcgtcgtcgtcggggggttactgccatgaggatcaattgccgagcagtccggcagttatatag

SEQ ID NO: 180 - DNA, 2003 bp, Trichoderma reesei
catgcctgcctcgagtgtcaacgccgcaagatccgctgcgacggcaagcagccctgcggccggtgccagtccagccgctcccggaggcggtgcgtgtatgagcagcatcgccagcgtctcgttccgtccaggaagtcagttcaacctcccccatgatgaggtcttcctaactatcttgtccaacttcttttgttgtttggtcttggctaacatcttccaactcgcaagtaagatcactggaagagctgtcacggaatctcgaagagtgccgctccgtgctgcggcgtctctttcccaaccatcaagtctcccacttgctatccttatcacgccaggagctctgcagcctcctagatcagccggcacagcaaaggactgttgacctgtcgccggtcccaccctcgcccaaggatgatcagcagcacccaacggagctcgagcagatgcccgcgcagaactctcagtgggacgaggaacgaagagaccgggacccgttgccggccgaagctgacgatgtaaacgccctgtccctcgccatggacaaacaggcttcttcctatctcggtgcctcgtccgtcaaagtcgccttgaccgtcatgcttcagatccagccccagcttcagctattgctcgcgtcacagccgtctgctgattcttctagtgacgacaacacccgcagcaaggttcctcttatccgtgcagcttccagatccgccaagaagcagtttcctatcccctggacatacaaggggcaagctcttgtcgatgcctacttcaaacgcgtccacgtcctcacccccttactggatgaggcctcgttccgaaaacattacagcgagggtcggcggtgcgatgctccctggctctccctgctcaacatggtctttgccacgagcagcatcatgtcaacgccatcgagcaacttgagccatatcaagtactacaaccaagccatagagcacatccatctcagtgcatttgggagcagccacatcgagaccatccatgccctggggcttcttggaggctactatctgcactacatcaaccgcccaaacatggccaacgccattatcggcgccgtcctcagaatggccactgctctcggtctgcatcgagaaccgccaccggaggagccacagtctgatcctgcggtcgttgagtcgcggaggcgcacttggtggaccttgttctgcctcgacacttggggcaccacaactcttgggcgcccttcgtttgggcgatgggggccggcgatcaatatccaaccccctaaacttgttacggagaatgtaggtcaatcatgaaccttgaagctgggtaaatggctggctgccatctaccgacacttgactcatttctctaaaacacaggaagaatacgactctgcccaattcgggggcatcatgcctttgctcgaaaacataaagttctgcaaaattgcgaccaaaattcaagacatgctcgcagtcagtcctcttctcgagtcagaagatcgacatcatcttgatagccttcttgtcgactggcacaacaacctcccctggcttcttcgatctacggaaccctgcgtagagtcactccatctatctcgaagcgtcatgacatggcggtactggaatctacgcatgcttctctaccgccctgttcttctgacgctggccagcaaaggccagttgcccatctcggagcaagatgtggccgccgtgaagaattgccaggaggccgcacgagagacggtggacagcgtctcaaaagggtggatgcgccagcaaatgtccggatggaatgccgtgtggtttctgtatcaagcagccatgataccgctggtcagcatcttatggcagcccgataaccccgccgttgtcgactggcgggcccaggttgagtcgacgctggagctgttcgaggccatgaaggattggtctctcacagcacgccgtagccgggatgtcgtcagccgcttgctcgaggccagttccaagatttccaacacgagacaa

SEQ ID NO: 181 - DNA, 2301 bp, Phaeosphaeria nodorum
atgttccataccttccagtcttctactgcgctccggtcgcctggtgacgacacggacgtttcggggaaaccatcacggccggcggggtcgcggcggatatcgacgagcaacgcctgtgtcgagtgcagaagacgaaagattcgctgcgacggctcacaaccgtgtggacagtgccaatggtaccagcatcctgaggcgtgcggctactccaagccagcccagagagtagtgccgagtagaaagttggtagacaagctttccaccaatatcgagcagtacaaggcggtactaaataagctctatggatccaaggaccttgcaacactggcgaacctgccaagagaagagctattggagatggcgctttcgtcatcttccacaccggggcaggtgacttcaccaaatagtctagaaggtcgcgccacgtctgagatccatacaggatcagatggcgctgatagcctcgaggcgctcgagcaagccccccctgaagaccctttctgggatgaagcacgcaagcatcaattgcgggtgcaaggcatttcagacgatgtgaacggcctttccatgtctgttgatagactatcctcttatgttggcatttcgtccgtcacagcagcactgaaggtcattgtaagatgcgctccacacgcacgtgctctcatcacacaacaaaccaatgaaactaccctgcccagtcgagccggatcaccacctccagaactcactgacagcagtccattggctttgccatcatccacgcatggccaggaactgctcgagagctattttgaccaggtccatcccatgatgccgctgatcgacgagaggaaattttggtccacctatttgtatggcaacagaaaagactcccaatggctgtgtttattgaacatcgtctttgcgcttggatcattggtgtcttcttcgacagacaatgaagctcactatgtgtatttcaaccgatgcagacaacacctttctttggagtcgttcggcagcggaaacttggaggtcctacaggcactcgtcatcatgagtgggctctacatgcattatctgaatcgaccaaatgaggcgcattcgctcatgggtggcgctctgcgcatggcaactacgcttggtctgcatcgcgagtattcggagcggagcgaagctggtagccacatgatgctaccggggttcgaagaatcactatctcccgagatgcggagacggatctggtggagtatattctgcctcgatgcctgggcatcaacaacgactgggcgaccctctttgggtcgcatggggccctctatcacggttttgaagccagggactgcggctgatgcggtctcgaccgtaccatctccaaacagccctcaatatatggaacagctgaaaatgctgccgctgatacattcctccgtattctgttcgatcgccacccgaatacaagaccgcctagtcgagcaacccctcctatcgccaaccgagacttcgacgtacgacgcccaattgctcaagtggtacgatgaactgccatctattttggtcaaacaagagccgtgtccagatttcctgcgccgtctcagactgatcatgaaatggcgctttcaaaacatccgtgttatcctccatcgaccgtatctcctcacagccgctttaagaggatgtgcatggatcaacatgagcgccgaggaaaaggtggcgattggaaaatgtcgcgttctcgccatgaagacaattgaagatatgagccaggagtgtatgcctgacctactatctggctggaattccgtctggttctgcttccaggcgtgcatggtctctctcgtctccttgttcagcgacgcgagcatgcccgaagaagtacacaaatggcaagcctccatcgagacggctctacaattcttcgattctatccgcgactacagcatcgcagcgaagcgaagtaaagacgccgtctcaaagctctaccaagcctacaaagcctatgcagttccggccacacaaatacccccacaaatatcaatgtcgcaacatcaataccaggctcagaccccatattcgatggccccgaatcctatgcaactcggcgcacatacaaatctcggagcacggaatccttaccagttcaatccaggcaccccatcatggtccagcgacccaaatttcctcaacaatttctgggacgacatgatgtgggacaccaacttgcctgatctgctcgagcatccgttcggactgagcaacgaattcgaatatggcggcgccgcacaggattctgggaacaatggttggctgcaggggaactga

SEQ ID NO: 182 - protein, 758 aa, Trichoderma reesei
MPQPHGPAPGLAAAPATGQRQEPLPFLATALAYTGASGPGPGSVSVSTSGQAHGLGSRSTGSFSINGSGVAGPGAGAGAGAGASTTNAMARHHPHDASSLSLALTPEVDDLDVDADASANGPQSPADAAGLNRRPGKRPAARGTAFYPRKRANTACQVCRARKTKCDNKKPACSYCVSVGATCIQSPVDLSSFDPASLKILDRIDELERLLRHAVPIPGPEAAAPPSSALAPAPTTGFSNHQRLPPLSRSRTFDGIGGAMHAPSSSVSSVSGRRHPDDNMDISLLPQRVDHILQWPVFQNSGSHHHSPASYRAPPDAISTPPSGSASLAGLIDMDSHRIYRLLDNFFLHIHCKNPILDEVLARRMVINAFLDGIDWSPASCLALIICALGCIATPFGPSGETKLGTQTYNDSQIFFQAAQKRIGILLVRSDIVGAQCLFLSGVYLMMVFQPVYAWRFFSQALAACQHFPFLARAQNLNASLDSMEMGRQDTQEQAVYWSAWKSERELRQELDLPDFDILHSGSTLYPPFFPAPPIAPAESPDGPDSETQRARAAWLFYLAEISLRRLTSRLSREALDLRQRYSSDSVLLDMLLDMMPEYEAQIREWSESLPADLSIHTPVEEDGICRSVLRGRMINLLEQIYWPFVMASISAHATRRPVKPAVAEFAKRGLETHMHQVHVNKPGFHHRHHGSMFMIRACTRSALVLLAAAKAGCAMPTDWEDSVYKTVGMLAYWEDEDRDLIHWRSTLERELALTRHE

SEQ ID NO: 183 - DNA, 2277 bp, Trichoderma reesei
atgccgcagcctcacggtccggcgccaggtctggctgcagctccagccacggggcaacgtcaggagccgctaccctttctcgcaacggccctggcatatacgggcgcctctgggcctggtccaggctcagtttctgtctctacttctggccaagctcatggcctcggttcccgttccacaggcagcttctccatcaatggcagtggcgtggctggccctggcgcaggtgcaggtgcaggtgctggtgctagtaccaccaacgccatggcccgtcatcatccccacgatgcgtcgtctctctccttggctctcaccccagaagtcgacgacctagatgtcgacgccgacgccagcgcaaacggcccacagtcaccggcagacgcggccggcctcaaccgccgccccgggaagcgcccggcagcccgcggcaccgccttctatccgaggaaacgggccaacaccgcctgccaggtctgcagagcccgcaagacaaagtgcgataacaagaagcccgcctgtagttactgcgtcagcgtcggcgccacgtgcattcagtccccggtggatctgtccagcttcgaccccgccagcctgaagatcctcgatcgcattgacgagctggagcgtctgctgcggcatgccgtccccatacccggccccgaggctgccgcgccgccatcgtcggctctcgctccggctccgaccacaggcttctccaaccaccagcggctgcccccactctcgcgatccaggacctttgacggcatcggtggtgcaatgcacgcccctagctcaagtgtcagcagtgtgtcgggtcgcaggcacccggacgacaatatggacatcagccttctgcctcagcgggtagaccacatcctgcagtggccggtcttccagaactccggcagccaccaccactcgccggcctcgtaccgcgcccctcccgatgccatctcgacccctccctccggctcggcatcgctggcgggccttattgatatggattcccaccgcatatacagattactagacaacttctttctgcacattcactgcaagaacccaatcctcgacgaagtcttggcacgccgcatggtaatcaacgcttttctggacggcattgactggtctcccgcctcgtgcctggcgctcatcatatgcgctctcggctgcatcgccacgccctttggccccagcggcgagaccaagctgggcacgcagacctacaacgactctcagatcttctttcaggccgcccagaagcgcatcggcattctgctcgtgcgctccgatattgtcggcgcccagtgtctgtttctatcaggcgtctatctgatgatggtcttccaacccgtctacgcatggcgcttcttctctcaggccctggcagcttgccaacactttcccttcctggctcgggcccagaacctcaacgcctcgctcgactcgatggaaatgggccgccaagatacccaagaacaggccgtgtactggtctgcgtggaagtcggaacgagagctacgacaggagctagaccttcctgatttcgacatcctccattccgggagcaccttgtatccgccctttttccccgcgcctccaattgccccggccgagtctccggacgggccagactccgagacacagcgggctcgcgccgcctggctgttctacctcgccgagatctcgctccgccgtctcaccagccgcctttccagagaagccttagatctccgccagcgctattcctctgactcggtactgctcgacatgctgctggatatgatgcccgagtacgaggctcagatccgcgagtggtcggagagcctgcccgctgacctctccatccatactcccgtggaagaggacggcatatgccggtcggtcctccgaggcaggatgattaatctcttggagcagatttactggccttttgtcatggccagcattagcgctcatgccacaaggcgtcccgtcaagccagctgtggcagagtttgccaaacggggcctggagacacacatgcatcaggtacacgtcaacaagcctggtttccatcatcgacatcatgggagcatgttcatgattcgggcctgcacgcgaagcgccttggttttgctagcagccgccaaagcggggtgtgccatgcccaccgactgggaggattctgtttacaaaaccgtcggcatgctggcctactgggaggacgaggacagagacttgatacactggagatcaaccctggagcgagagctcgcactcacccggcacgaatga

SEQ ID NO: 184 - protein, 13 aa, Artificial Sequence
  Synthetic Construct
  VARIANT 1: Xaa = Val or Leu
  VARIANT 2: Xaa = Glu or Asp
  VARIANT 3: Xaa = Lys or Ala or Glu
  VARIANT 6: Xaa = Gln or Thr or Ser or Asn
  VARIANT 7: Xaa = Ser or Thr or Asn
  VARIANT 8: Xaa = Leu or Val or Ile
  VARIANT 9, 10: Xaa = Asp or Glu
  VARIANT 11: Xaa = Tyr or Cys
  VARIANT 12: Xaa = Arg or Lys
  VARIANT 13: Xaa = Ser or Thr or Val
XXXLSXXXXXXXX

SEQ ID NO: 185 - protein, 19 aa, Artificial Sequence
  Synthetic Construct
  VARIANT 1: Xaa = Met or Leu or Ile
  VARIANT 2: Xaa = Ser or Thr or Ile
  VARIANT 9: Xaa = Phe or Leu or Trp
  VARIANT 10: Xaa = Ile or Val or Leu or Cys or Thr
  VARIANT 11: Xaa = Phe or Tyr
  VARIANT 13: Xaa = Ala or Ser
  VARIANT 14: Xaa = Any Amino Acid
  VARIANT 15: Xaa = Met or Leu
  VARIANT 16: Xaa = Val or Ile
  VARIANT 19: Xaa = Ile or Leu or Val
XXGWNAVWXXXQXXXXPLX

SEQ ID NO: 186 - protein, 6 aa, Artificial Sequence
  Synthetic Construct
  VARIANT 1: Xaa = Glu or Asp
  VARIANT 2: Xaa = Any Amino Acid
  VARIANT 4: Xaa = Ala or Val
  VARIANT 5: Xaa = Ala or Val or Ile
  VARIANT 6: Xaa = Ser or Thr or Ala or Leu
XXLXXX

SEQ ID NO: 187 - protein, 6 aa, Artificial Sequence
  Synthetic Construct
  VARIANT 2: Xaa = Phe or Tyr
  VARIANT 3: Xaa = His or Ile or Leu
  VARIANT 6: Xaa = Gln or Glu
MXXTFX

SEQ ID NO: 188 - protein, 17 aa, Artificial Sequence
  Synthetic Construct
  VARIANT 4: Xaa = Lys or Arg
  VARIANT 5: Xaa = Leu or Met
  VARIANT 7: Xaa = Leu or Ile
  VARIANT 8: Xaa = Glu or Asp
  VARIANT 9: Xaa = Arg or Lys or Gln or His
  VARIANT 15: Xaa = Ser or Asn or Gly
AGDXXIXXXLNRIEXLL

SEQ ID NO: 189 - protein, 17 aa, Artificial Sequence
  Synthetic Construct
  VARIANT 2: Xaa = His or Arg
  VARIANT 3: Xaa = Ala or Asp or Glu
  VARIANT 6: Xaa = Met or Leu or Ile
  VARIANT 9: Xaa = Ile or Leu
  VARIANT 10: Xaa = Trp or Phe
  VARIANT 16: Xaa = Met or Ile
  VARIANT 17: Xaa = Val or Met or Ile
HXXGHXPYXXQGALSXX

SEQ ID NO: 190 - protein, 15 aa, Artificial Sequence
  Synthetic Construct
  VARIANT 1: Xaa = Asn or Pro
  VARIANT 2: Xaa = Pro or Ser
  VARIANT 3: Xaa = Leu or Lys or Thr or Ser
  VARIANT 5,6: Xaa = Arg or Lys
  VARIANT 7: Xaa = Asn or Ser or Pro
  VARIANT 8: Xaa = Thr or Ser or Asn
  VARIANT 9: Xaa = Glu or Asp or Ser or Thr
  VARIANT 10,11: Xaa = Any Amino Acid
  VARIANT 12: Xaa = Val or Ile or Ala or Thr
  VARIANT 13: Xaa = Asp or Glu
XXXKXXXXXXXXXYP

SEQ ID NO: 191 - protein, 11 aa, Artificial Sequence
  Synthetic Construct
  VARIANT 2: Xaa = Gly or Thr or Ser or Val or Asn
  VARIANT 3: Xaa = Phe or Leu or Ile
  VARIANT 5: Xaa = Thr or Ser
  VARIANT 7: Xaa = Ser or Asn or Val or Ala or Thr
  VARIANT 8: Xaa = Ala or Asn or Ser
  VARIANT 9: Xaa = Gln or Thr or Pro
  VARIANT 10: Xaa = Pro or Ala
  VARIANT 11: Xaa = Thr or Ser
GXXGXWXXXXX

SEQ ID NO: 192 - protein, 8 aa, Artificial Sequence
  Synthetic Construct
  VARIANT 2: Xaa = Asn or His
  VARIANT 3: Xaa = Leu or Met
  VARIANT 4: Xaa = Ser or Thr
  VARIANT 5: Xaa = Gln or Pro
  VARIANT 6: Xaa = Ser or Thr or Pro
  VARIANT 7: Xaa = Ser or Pro
  VARIANT 8: Xaa = Asp or Glu
RXXXXXXX

SEQ ID NO: 193 - protein, 696 aa, Gibberella zeae; identical to SEQ ID NO: 29

SEQ ID NO: 194 - protein, 699 aa, Nectria haematococca; identical to SEQ ID NO: 34

SEQ ID NO: 195 - protein, 677 aa, Neurospora tetrasperma; identical to SEQ ID NO: 48

SEQ ID NO: 196 - protein, 710 aa, Sordaria macrospora; identical to SEQ ID NO: 42

SEQ ID NO: 197 - protein, 704 aa, Chaetomium globosum; identical to SEQ ID NO: 28

SEQ ID NO: 198 - protein, 706 aa, Podospora anserina; identical to SEQ ID NO: 38

SEQ ID NO: 199 - protein, 517 aa, Verticillium albo-atrum; identical to SEQ ID NO: 44

SEQ ID NO: 200 - protein, 692 aa, Glomerella graminicola; identical to SEQ ID NO: 30

SEQ ID NO: 201 - protein, 682 aa, Metarhizium anisopliae; identical to SEQ ID NO: 47

SEQ ID NO: 202 - protein, 535 aa, Botryotinia fuckeliana; identical to SEQ ID NO: 27

SEQ ID NO: 203 - protein, 688 aa, Sclerotinia sclerotiorum; identical to SEQ ID NO: 41

SEQ ID NO: 204 - protein, 696 aa, Grosmannia clavigera; identical to SEQ ID NO: 31

SEQ ID NO: 205 - protein, 632 aa, Aspergillus nidulans; identical to SEQ ID NO: 24

SEQ ID NO: 206 - protein, 633 aa, Aspergillus fumigatus; identical to SEQ ID NO: 23

SEQ ID NO: 207 - protein, 638 aa, Aspergillus oryzae; identical to SEQ ID NO: 18

SEQ ID NO: 208 - protein, 671 aa, Penicillium chrysogenum; identical to SEQ ID NO: 36
  VARIANT 58: Xaa = Any Amino Acid

SEQ ID NO: 209 - protein, 651 aa, Aspergillus niger; identical to SEQ ID NO: 17

SEQ ID NO: 210 - protein, 712 aa, Pyrenophora teres; identical to SEQ ID NO: 39

SEQ ID NO: 211 - protein, 710 aa, Leptosphaeria maculans; identical to SEQ ID NO: 32

SEQ ID NO: 212 - protein, 603 aa, Talaromyces stipitatus; identical to SEQ ID NO: 46

SEQ ID NO: 213 - protein, 551 aa, Neurospora crassa
MAMENDTSSGPSRKRLRTSHACDLCRFRKIRCDGDTPCAACVATENDCTYGSEANSSSHHVLSSAVGSSVGRGSFSGGSLTDLRITPRPTLCPHPDELDNANNLENAVLESRHTSTTESILQWPHFDVFPSLRKDYTSIFHLEQSRPRIKTKKRDIYPYMTEEEVDSILDAFGHAVNFWYPTTSSDQLHNARALITNGNFEDNDELCVCLALLVMALGCASKVTAGLMESAAVPESEQRRRATYRATGDMYFESALKKLYVAHMDVSSIATQCLFFVALYFAFLRRPLQAWEYISAAATKCLLLLSYSSQDSTSEDQERIRRIFWSCYILESDYLAELSNLPLSGIARVESSVPLPDAWYSTHSNAQEEEQSSLYFLACISMRRLLNRVHQLLYARGTGASLDDKRFPGIVKELDHQLDEWRTVLPEAFAFEVEWPPVGAKHNITGVKTEHGGFLRQRYLTCRSVIYRPMAGAMLVLLAACRISLLKDLIGPEILQAGSHLRELLVGWQKVQGDPSSPSVNQSIHIIKEAERFIRQVYKGGKDEEQGRIEE

SEQ ID NO: 214 - protein, 704 aa, Aspergillus nidulans; identical to SEQ ID NO: 67

SEQ ID NO: 215 - protein, 745 aa, Penicillium marneffei; identical to SEQ ID NO: 91

SEQ ID NO: 216 - protein, 749 aa, Talaromyces stipitatus; identical to SEQ ID NO: 89

SEQ ID NO: 217 - protein, 773 aa, Aspergillus nidulans; identical to SEQ ID NO: 85

SEQ ID NO: 218 - protein, 777 aa, Aspergillus niger; identical to SEQ ID NO: 80

SEQ ID NO: 219 - protein, 771 aa, Aspergillus oryzae; identical to SEQ ID NO: 82

SEQ ID NO: 220 - protein, 767 aa, Penicillium chrysogenum; identical to SEQ ID NO: 83

SEQ ID NO: 221 - protein, 757 aa, Coccidioides immitis; identical to SEQ ID NO: 87

SEQ ID NO: 222 - protein, 794 aa, Coccidioides posadasii; identical to SEQ ID NO: 86

SEQ ID NO: 223 - protein, 834 aa, Neurospora tetrasperma; identical to SEQ ID NO: 96

SEQ ID NO: 224 - protein, 803 aa, Sordaria macrospora; identical to SEQ ID NO: 70

SEQ ID NO: 225 - protein, 792 aa, Podospora anserina
NMAPSIPVPTQGGMFHTFQGVTPRKQSTDSQDSTKTSSTGTAKRITTPHACAECKRRKIRCDGQQPCGQCLSSRAPKRCFYDKHRQRVIPSRKTLEALSQSLEECRSILKRLYPTQDVQSLLPLSRQELLSLLDRPTIDTSVGGLPSPPLNTSPMSDLDSPMMPKTENLLEQMPSRDTEWDEERRGRDPIPAEADDINALSLSVDRQTSYLGASSIKAALMVMLKVQPGLRNSLAAPLNGVEMSHNYPAIRQKPTTQKDPQRIPWSWKGQTLIDAYFKRIHAFVPMLDESTFRADYLEGQRTDAPWLALLNMVFAMGSIAAMKSDDYNHINYYNRAMEHLPMDAFGSSHIETVQALALIGGYYLHYINRPNMANAVLGAAIRMASALGLHRESITVGLPGSDIIAAETRRRTWWSLFCLDTWATTTMGRPSFGRWGPAINIRPPEFGINANRDSSQHAGILPLIENIKFCKIATQIQDMLAITPLLRTEDRCAIDAQLVNWYTSLPWLLRTTDPCAEPLYMARCIMKWRYQNLRMLLHRPVLLSLASSGLNPHTQACDADLQAIETCRELAAATIEDVGREWTRNQMSGWNAVWFLYQAAMVPLVSVFWQWGSPRVPEWLKQIEQVLDLLEVMEEWSLAARRSREVVWRMYEASRAVQAQGAAARSQSPAGLHITTTADSIVVGGGEVHMSPIGLEPVDGMGGMMGLLDQGGLWDLDGMYWGGNGPQSPTHTGNPDDSAAAAEFAAYAAAQQAASAAHHHHPELMQHVDYGMMHHHHAGHHHVGMEGFGYVQ

SEQ ID NO: 226 - protein, 751 aa, Glomerella graminicola; identical to SEQ ID NO: 73

SEQ ID NO: 227 - protein, 781 aa, Magnaporthe oryzae; identical to SEQ ID NO: 74

SEQ ID NO: 228 - protein, 647 aa, Nectria haematococca; identical to SEQ ID NO: 76

SEQ ID NO: 229 - protein, 608 aa, Trichoderma reesei; identical to SEQ ID NO: 94

SEQ ID NO: 230 - protein, 829 aa, Verticillium albo-atrum; identical to SEQ ID NO: 75

SEQ ID NO: 231 - protein, 642 aa, Pyrenophora tritici-repentis; identical to SEQ ID NO: 90

SEQ ID NO: 232 - protein, 787 aa, Pyrenophora teres; identical to SEQ ID NO: 78

SEQ ID NO: 233 - protein, 788 aa, Leptosphaeria maculans
DFDTSSCSTSQHDMFHTFQSSAAMRSPDADIDASGKPSRPPGSRRISTSNACVECRRRKIRCDGSQPCGQCQWYQHPEACGYSKPAQRVVPSRKLVDKLSNNIEQYKAVLTKLYGGRNLESLANLPREELLELALSSPSITLTTSPSTTESVALSDVQAGSDGAESLEALEQAPPEDPYWDEARKHQLRVQGISDDVNGLSMSVDRLSSYVGISSITAALKVIVRCAPQARLLIAHNSQETALPSRAGSPPPELADNNPLAVPSAQHGQQLIEAFFDRVHPFFPMIDERKFWNTYLYGDRKDSAWLGLLNTVFALGSLSSSTADNEAHYVYFTRARQHVSLESFGSGNLEVLQTLAIMSGYYMHYLNRPNEAHSLMGGTLRMATALGLHREYSERSGSSRKFTAAGEEDSISPEMRRRIWWSLFCLDSWASTTTGRPSLGRMGPSITVMRPGTAPNAVQTIPPPDSPQYIEQLKILPLIHASAFCQIATRIQDRLVETPLLSLAETAAFDMQILKWHEELPSILSDLNEPCPDFLRRVRTVMKWRFQNIRLVLHRPVLLTTALRRSSWNSLSPEEKVAVGKCRMIAAKTIQELSKECMADLISGWNAVWFCFQACMVPLVSLFSDCSIPEEVKKWNESLETALQFFETAKDWSIAAKRSGDAVTRLYAAYKTYASTMLSQPQAPMQTVQPHYQDSNNFALPGTVTTSSMLNTHQIYSQAQPAFQYNPSTPTWANANDPTILNNLWDDMMWDTNLPDMLETPFGLNNDWEYASTAQDSGSGGACWMHGN

SEQ ID NO: 234 - protein, 768 aa, Neurospora crassa; identical to SEQ ID NO: 95

SEQ ID NO: 235 - protein, 32 aa, Artificial Sequence
  Synthetic Construct
CEVCRSRKSRCDGTKPKCKLCTELGAECIYRE

SEQ ID NO: 236 - protein, 38 aa, Artificial Sequence
  Synthetic Construct
  VARIANT 21,24,34: Xaa = Any Amino Acid
CAECRRRKIRCDGEQPCGQCXWYXKPKRCFYRVXPSRK

SEQ ID NO: 237 - protein, 259 aa, Artificial Sequence
  Synthetic Construct
  VARIANT 62,76,84,133,183,189,195: Xaa = Any Amino Acid
IEAYFERVNVWYACVNPYTWRSHYRTALSNGFREGPESCIVLLVLALGQASLRGSISRIVPXEDPPGLQYFTAAWXLLPGMMTXNSVLAAQCHLLAAAYLFYLVRPLEAWNLLCTTSTKLQLLLMAPNRVPPXQRELSERIYWNALLFESDLLAELDLPHSGIVQFEENVGLPGGFEGEEDEXDEEADXDQEIAXVTAVGRDELWYFLAEIALRRLLNRVSQLIYSKDTPYSKGPSMASTTSLEPIVAELDFQLTQWYE

SEQ ID NO: 238 - protein, 171 aa, Artificial Sequence
  Synthetic Construct
  VARIANT 10,12,18,58,59,69,78,100,125,126,135,138,167: Xaa = Any Amino Acid
IDAYFKRVHXFXPMLDEXTFRATYLEGQRKDAPWLALLNMVFALGSIAAMKSDDYNHXXYYNRAMEHLXLDSFGSSHXETVQALALMGGYYLHYINRPNXANALMGAALRMASALGLHRESLAQXXASSQKGVNXSDXASAETRRRTWWSLFCLDTWATTTLGRPSXGRWG

SEQ ID NO: 239 - DNA, 19 bp, Artificial Sequence
  Synthetic Construct
  VARIANT 1: n = T, A, or G
  VARIANT 2: n = C, T or G
  VARIANT 3: n = C, T or G
  VARIANT 4: n = G, C or T
  VARIANT 5: n = G or C
  VARIANT 6: n = G, C or A
  VARIANT 7: n = A, T or C
  VARIANT 8: n = A, T, C or G
  VARIANT 9: n = C, T or A
  VARIANT 10: n = G, C or A
  VARIANT 11: n = C, G or A
  VARIANT 12: n = G or C
  VARIANT 13: n = G, T or C
  VARIANT 14: n = C, G or A
  VARIANT 15: n = C, A or T
  VARIANT 16: n = C
  VARIANT 17: n = G or A
  VARIANT 18: n = T, G or A
  VARIANT 19: n = C, T or A
nnnnnnnnnnnnnnnnnnn

SEQ ID NO: 240 - DNA, 18 bp, Artificial Sequence
  Synthetic Construct
  VARIANT 1: n = T or A
  VARIANT 2: n = C or T
  VARIANT 3: n = G
  VARIANT 4: n = G
  VARIANT 5: n = A, G or C
  VARIANT 6: n = G, C or A
  VARIANT 7: n = C, T or G
  VARIANT 8: n = C, G or T
  VARIANT 9: n = T, A or G
  VARIANT 10: n = C, G, A or T
  VARIANT 11: n = T or A
  VARIANT 12: n = T, A or C
  VARIANT 13: n = C, T or G
  VARIANT 14: n = C or T
  VARIANT 15: n = T, G or A
  VARIANT 16: n = C
  VARIANT 17: n = C or T
  VARIANT 18: n = G or T
nnnnnnnnnnnnnnnnnn

SEQ ID NO: 241 - protein, 765 aa, Artificial Sequence
  Synthetic Construct
  VARIANT 14, 54, 66, 101, 102, 109, 110, 218, 233, 252, 254, 262,336, 400, 414, 422, 471, 521, 527, 533, 624, 646, 654, 746,755, 763: Xaa = Any Amino Acid
MAGMSPSSNGDSPXVYTGSMTMAAQAAPNVVRQFPLPSRDSFTIEIPSPQLAAXSNGGVNTLKSPXSLKSPNGARTPSFSREGILGSAFQKARNLSQSSEXXRPDIVNXXRQNNNHNQVSNGNQKAPSDEGGSNPLKRRNTDAGVDYPRRRATIALQCEVCRSRKSRCDGTKPKCKLCTELGAECIYREPGIKLDAGDKLILERLNRIESLLQSNLGXAGQTSGLGLSSNSPXMSNGTGLSGDDLMMKASNXAXHFVSVIPXGGLGTWSNPPTGTNISTMPKVHTNAALHLLQWPLIRDLVSRPYDPQILLQLEMAREPLHSLTKTPCSVDLSNTXAYIEAYFERVNVWYACVNPYTWRSHYRTALSNGFREGPESCIVLLVLALGQASLRGSISRIVPXEDPPGLQYFTAAWXLLPGMMTXNSVLAAQCHLLAAAYLFYLVRPLEAWNLLCTTSTKLQLLLMAPNRVPPXQRELSERIYWNALLFESDLLAELDLPHSGIVQFEENVGLPGGFEGEEDEXDEEADXDQEIAXVTAVGRDELWYFLAEIALRRLLNRVSQLIYSKDTPYSKGPSMASTTSLEPIVAELDFQLTQWYESLPLPLQFPFTRTPLSDPVQTVLRLRXFACRTIIYRPYILAVLDNEQAXLDPAVREXCHKCLEASIRQLEHITAHHAGHMPYLWQGALSIVSQTLLIMGATMSPSLSSILLSLVPHRDTIDQIINDVVMEVERYAHLAPSLSLSAEIIXEAEVRRRTXLSGAGRRXEV

SEQ ID NO: 242 - protein, 907 aa, Artificial Sequence
  Synthetic Construct
  VARIANT 20, 21, 27, 36, 37, 43, 44, 45: Xaa = Any Amino Acid
  VARIANT 47: Xaa = Gly, Arg, Val, Ser or Ile
  VARIANT 73, 76, 91, 112, 119, 121, 129, 141, 144, 146, 172,236, 254, 255, 266, 268, 302, 304, 310, 350, 351, 361, 370,392, 417, 418, 427, 430, 459, 468, 469, 475, 479, 526, 531,589, 601, 605, 616, 646: Xaa = Any Amino Acid
  VARIANT 656, 661, 664, 673, 696, 698, 700, 701, 706, 709, 710, 711,717, 719, 720, 721, 729, 732, 733, 736, 773, 789, 820, 822,835, 838, 840, 846, 853, 860, 861, 862, 863, 867, 873, 875,876, 877, 879, 884, 885, 890, 891, 894, 896, 898, 900: Xaa = Any Amino Acid
  VARIANT 901, 904, 907: Xaa = Any Amino Acid
MAPSISIPTQGGMFHTFQGXXNPKPAXDSQDSGKSXXPKRSSXXXRXTTPRACAECRRRKIRCDGEQPCGQCXWYXKPKRCFYDKPRQRVXPSRKYPHLEKLSQSLEEYRSXLKRLFPXQXVESLLPLXREELLELLDRPXPDXTXQHTQGLPSPPLNTSPSVEDHVSPLSXEDENLESLEQMPTEDTEWDECERRERDPIPAESDDVNALSLSVDRQSSYLGASSIKAALKVILXLQPGLRSSLSRPPNSQEXXHNAASQPPPEXPXWRQKSSTQPKDPQRIPWSWKGQQLIDAYFKRVHXFXPMLDEXTFRATYLEGQRKDAPWLALLNMVFALGSIAAMKSDDYNHXXYYNRAMEHLXLDSFGSSHXETVQALALMGGYYLHYINRPNXANALMGAALRMASALGLHRESLAQXXASSQKGVNXSDXASAETRRRTWWSLFCLDTWATTTLGRPSXGRWGPAITXXPPEFGXNAVXRIPPPDSSQHIEQAGILPLIENVKFCKIATQIQDMLAASPLLRTEEXCHLDXQLVEWYENLPWLLRDTEPCAEPLYIARTVMKWRYQNLRMLLHRPVLLSYAMRRINPYXALRDEERAAIEXCREXAAATIEDIARXWTRNQMSGWNAVWFLFQAAMVPLVSLFWQXAGTPTDPRAXVESWXAQXETALELLEXMEDWSLTAKRSREVVSRIYEASXRXQXXGAAAXQAXXXRSQSPXSXXXTTASLGSXGPXXNQXSLMGPSPGTGNGEAHMSPIGLEPVDGLAPAFIQYNPXTPGMMGDLDQPAILQXLWDLDGMSWGDNPNLWVHHGHHSTHPDDAVXTXAEFAAAFPTADVXDGXLXHHSAMXMHMDPGXMMGHHTXXXXAGAXFGQGQXGXXXKXGNHEXXFFGGXXGDXYXFXNXXPNXYRX

What is claimed is:

1. A method of degrading cellulose-containing material, the method comprising:
   a) contacting cellulose-containing material with a fungal host cell comprising at least one recombinant nucleic acid encoding a transcription factor protein, wherein said transcription factor protein is a clr-2 transcription factor protein, selected from the group consisting of NCU08042 (SEQ ID NO: 4), CAE85541.1 (SEQ ID NO: 69), XP_003347695.1 (SEQ ID NO: 70), XP_001910304.1 (SEQ ID NO: 71), XP_001223809.1 (SEQ ID NO: 72), EFQ33148.1 (SEQ ID NO: 73), XP_363907.1 (SEQ ID NO: 74), XP_003006605.1 (SEQ ID NO: 75), XP_003039508.1 (SEQ ID NO: 76), XP_001558061.1 (SEQ ID NO: 77), XP_003299229.1 (SEQ ID NO: 78), CBX99480.1 (SEQ ID NO: 79), XP_001395273.2 (SEQ ID NO: 80), XP_384856.1 (SEQ ID NO: 81), XP_002568399.1 (SEQ ID NO: 83), EDP48079.1 (SEQ ID NO: 84), AN3369 (SEQ ID NO: 85), XP_003065241.1 (SEQ ID NO: 86), XP_001240945.1 (SEQ ID NO: 87), XP_002542864.1 (SEQ ID NO: 88), XP_002480618.1 (SEQ ID NO: 89), XP_001940688.1 (SEQ ID NO: 90), XP_002151678.1 (SEQ ID NO: 91), EFY98873.1 (SEQ ID NO: 92), XP_001590666.1 (SEQ ID NO: 93), EGR49862 (SEQ ID NO: 94), XP_961763.2 (SEQ ID NO: 95), EG059545.1 (SEQ ID NO: 96), SEQ ID NO: 97, CAK48469.1 (SEQ ID NO: 49), EFW15774.1 (SEQ ID NO: 50), XP_003040361.1 (SEQ ID NO: 51), XP_002561020.1 (SEQ ID NO: 52), XP_003009097.1 (SEQ ID NO: 53), XP_003001732.1 (SEQ ID NO: 54), XP_001272415.1 (SEQ ID NO: 55), XP_001268264.1 (SEQ ID NO: 56), XP_002384489.1 (SEQ ID NO: 57), XP_001217271.1 (SEQ ID NO: 58), XP_001214698.1 (SEQ ID NO: 59), XP_001218515.1 (SEQ ID NO: 60), EGP89821.1 (SEQ ID NO: 61), XP_001262768.1 (SEQ ID NO: 62), XP_001258355.1 (SEQ ID NO: 63), EDP49780.1 (SEQ ID NO: 64), XP_746801.1 (SEQ ID NO: 65), XP_751092.1 (SEQ ID NO: 66), AN6832 (SEQ ID NO: 67), EFQ30604.1 (SEQ ID NO: 68), *Podospora_anserina*_S_mat+(SEQ ID NO: 225), and *Leptosphaeria_maculans*_JN3 (SEQ ID NO: 233); and
   b) incubating said fungal host cell and cellulose-containing material under conditions sufficient for the fungal host cell to degrade said cellulose-containing material.

2. The method of claim 1, wherein said fungal host cell is incubated under conditions sufficient for the fungal host cell to express said transcription factor protein.

3. The method of claim 1, wherein said fungal host cell produces a greater amount of one or more cellulases than a corresponding fungal host cell lacking said at least one recombinant nucleic acid.

4. The method of claim 1, wherein said cellulose-containing material comprises biomass.

5. The method of claim 4, wherein said biomass is selected from the group consisting of *Miscanthus*, switchgrass, cord grass, rye grass, reed canary grass, elephant grass, common reed, wheat straw, barley straw, canola straw, oat straw, corn stover, soybean stover, oat hulls, sorghum, rice hulls, sugarcane bagasse, corn fiber, Distillers Dried Grains with Solubles (DDGS), Blue Stem, corncobs, pine wood, birch wood, willow wood, aspen wood, poplar wood, and energy cane.

6. The method of claim 1, wherein said fungal host cell further comprises one or more recombinant nucleic acids that encode a polypeptide involved in a biochemical pathway for the production of at least one biofuel and further comprising the step of incubating said fungal host cell with said degraded cellulose-containing material under conditions sufficient for the fungal host cell to convert the cellulose-containing material to at least one biofuel.

7. The method of claim 6, wherein said biofuel is selected from the group consisting of ethanol, n-propanol, n-butanol, iso-butanol, 3-methyl-1-butanol, 2-methyl-1-butanol, 3-methyl-1-pentanol, and octanol.

8. The method claim 1, wherein said degraded cellulose-containing material is cultured with a fermentative microorganism under conditions sufficient to produce at least one fermentation product from the degraded cellulose-containing material.

9. The method claim 1, wherein said at least one recombinant nucleic acid is SEQ ID NO: 5.

10. The method claim 1, wherein said fungal host cell further comprises at least one additional recombinant nucleic acid encoding an additional transcription factor protein, wherein said additional transcription factor protein is a clr-1 transcription factor protein, selected from the group consisting of NCU07705 (SEQ ID NO: 1), XP_755084.1 (SEQ ID NO: 23), AN5808 (SEQ ID NO: 24), CAK44822.1 (SEQ ID NO: 25), BAE65369.1 (SEQ ID NO: 26), XP_001555641.1 (SEQ ID NO: 27), XP_001223845.1 (SEQ ID NO: 28), XP_385244.1 (SEQ ID NO: 29), EFQ33187.1 (SEQ ID NO: 30), EFX05743.1 (SEQ ID NO: 31), CBY01925.1 (SEQ ID NO: 32), XP_363808.2 (SEQ ID NO: 33), XP_003046557.1 (SEQ ID NO: 34), NCU00808 (SEQ ID NO: 35), XP_002561618.1 (SEQ ID NO: 36), XP_001793692.1 (SEQ ID NO: 37), XP_001910210.1 (SEQ ID NO: 38), XP_003302859.1 (SEQ ID NO: 39), XP_001941914.1 (SEQ ID NO: 40), XP_001586051.1 (SEQ ID NO: 41), XP_003349955.1 (SEQ ID NO: 42), SEQ ID NO: 43), XP_003009138.1 (SEQ ID NO: 44), XP_002147949.1 (SEQ ID NO: 45), XP_002481929.1 (SEQ ID NO: 46), EFY98315.1 (SEQ ID NO: 47), EG059041.1 (SEQ ID NO: 48), XP_001267691.1 (SEQ ID NO: 15), XP_002378199.1 (SEQ ID NO: 16), CAK44822.1 (SEQ ID NO: 17), BAE65369.1 (SEQ ID NO: 18), XP_001209542.1 (SEQ ID NO: 19), EFY86844.1 (SEQ ID NO: 20), EGP86518.1 (SEQ ID NO: 21), XP_001260268.1 (SEQ ID NO: 22), *Trichoderma reesei* clr-1 (SEQ ID NO: 182), and NCU00808 (SEQ ID NO: 213).

11. The method claim 10, wherein the at least one additional recombinant nucleic acid encoding said additional transcription factor protein is SEQ ID NO: 2.

12. The method claim 1, wherein said fungal host cell further comprises at least one recombinant nucleic acid encoding a hemicellulase.

13. The method of claim 1, wherein said fungal host cell is selected from the group consisting of *Neurospora crassa, Metarhizium anisopliae, Gibberella zeae, Nectria haematococca, Magnaporthe oryzae, Neurospora tetrasperma, Sordaria macrospora, Chaetomium globosum, Podospora anserina, Verticillium albo-atrum, Glomerella graminicola, Grosmannia clavigera, Sclerotinia sclerotiorum, Botryotinia fuckeliana, Aspergillus oryzae, Aspergillus nidulans, Aspergillus niger, Aspergillus fumigatus, Penicillium chrysogenum, Leptosphaeria maculans, Phaeosphaeria nodorum, Pyrenophora tritici-repentis, Pyrenophora teres, Penicillium marneffei, Talaromyces stipitatus, Trichoderma reesei, Uncinocarpus reesii, Coccidioides immitis, Coccidioides posadasii, Saccharomyces cerevisiae, Schizosaccharomyces pombe, Sporotrichum thermophile (Myceliophthora thermophila), Thielavia terrestris-thermophilic, Acremonium cellulolyticus, Yarrowia lipolytica, Hansenula polymorpha, Kluyveromyces lactis, Pichia pastoris, Mycosphaerella graminicola, Neosartorya fischeri, Thermomyces lanuginosus (Humicola brevis, Humicola brevispora, Humicola grisea, Humicola lanuginosa, Monotospora lanuginosa, Sepedonium lanuginosum), Talaromyces thermophilus (Talaromyces dupontii, Penicillium dupontii), and Chrysosporium lucknowense.*

14. A method of increasing the production of one or more cellulases from a fungal cell, the method comprising:
(a) providing a fungal host cell comprising at least one recombinant nucleic acid encoding a transcription factor protein, wherein said transcription factor protein is a clr-2 transcription factor protein, selected from the group consisting of NCU08042 (SEQ ID NO: 4), CAE85541.1 (SEQ ID NO: 69), XP_003347695.1 (SEQ ID NO: 70), XP_001910304.1 (SEQ ID NO: 71), XP_001223809.1 (SEQ ID NO: 72), EFQ33148.1 (SEQ ID NO: 73), XP_363907.1 (SEQ ID NO: 74), XP_003006605.1 (SEQ ID NO: 75), XP_003039508.1 (SEQ ID NO: 76), XP_001558061.1 (SEQ ID NO: 77), XP_003299229.1 (SEQ ID NO: 78), CBX99480.1 (SEQ ID NO: 79), XP_001395273.2 (SEQ ID NO: 80), XP_384856.1 (SEQ ID NO: 81), XP_002568399.1 (SEQ ID NO: 83), EDP48079.1 (SEQ ID NO: 84), AN3369 (SEQ ID NO: 85), XP_003065241.1 (SEQ ID NO: 86), XP_001240945.1 (SEQ ID NO: 87), XP_002542864.1 (SEQ ID NO: 88), XP_002480618.1 (SEQ ID NO: 89), XP_001940688.1 (SEQ ID NO: 90), XP_002151678.1 (SEQ ID NO: 91), EFY98873.1 (SEQ ID NO: 92), XP_001590666.1 (SEQ ID NO: 93), EGR49862 (SEQ ID NO: 94), XP_961763.2 (SEQ ID NO: 95), EG059545.1 (SEQ ID NO: 96), SEQ ID NO: 97, CAK48469.1 (SEQ ID NO: 49), EFW15774.1 (SEQ ID NO: 50), XP_003040361.1 (SEQ ID NO: 51), XP_002561020.1 (SEQ ID NO: 52), XP_003009097.1 (SEQ ID NO: 53), XP_003001732.1 (SEQ ID NO: 54), XP_001272415.1 (SEQ ID NO: 55), XP_001268264.1 (SEQ ID NO: 56), XP_002384489.1 (SEQ ID NO: 57), XP_001217271.1 (SEQ ID NO: 58), XP_001214698.1 (SEQ ID NO: 59), XP_001218515.1 (SEQ ID NO: 60), EGP89821.1 (SEQ ID NO: 61), XP_001262768.1 (SEQ ID NO: 62), XP_001258355.1 (SEQ ID NO: 63), EDP49780.1 (SEQ ID NO: 64), XP_746801.1 (SEQ ID NO: 65), XP_751092.1 (SEQ ID NO: 66), AN6832 (SEQ ID NO: 67), EFQ30604.1 (SEQ ID NO: 68), Podospora_anserina_S_mat+(SEQ ID NO: 225), and Leptosphaeria_maculans_JN3 (SEQ ID NO: 233); and
(b) culturing said host cell under conditions sufficient to support the expression of said at least one recombinant nucleic acid, wherein said fungal host cell produces a greater amount of said one or more cellulases than a corresponding host cell lacking said at least one recombinant nucleic acid.

15. The method of claim 14, wherein said fungal host cell is cultured in the absence of cellulose.

* * * * *